United States Patent
Walsh et al.

(10) Patent No.: US 11,046,968 B2
(45) Date of Patent: *Jun. 29, 2021

(54) PRODUCTION OF OMEGA 3 LONG CHAIN POLYUNSATURATED FATTY ACIDS IN OILSEED CROPS BY A THRAUSTOCHYTRID PUFA SYNTHASE

(71) Applicants: Dow AgroSciences LLC, Indianapolis, IN (US); DSM IP Assets B.V., Heerlen (NL)

(72) Inventors: Terence A. Walsh, Carmel, IN (US); Daniel J. Gachotte, Indianapolis, IN (US); Cory M. Larsen, Zionsville, IN (US); Scott Bevan, Indianapolis, IN (US); P. Ann Owens-Merlo, Carmel, IN (US); James G. Metz, Longmont, CO (US); Ross Zirkle, Mt. Airy, MD (US)

(73) Assignees: Dow AgroSciences LLC, Indianapolis, IN (US); DSM IP Assets B.V., Heerlen (NL)

( * ) Notice: Subject to any disclaimer, the term of this patent is extended or adjusted under 35 U.S.C. 154(b) by 195 days.

This patent is subject to a terminal disclaimer.

(21) Appl. No.: 16/006,485

(22) Filed: Jun. 12, 2018

(65) Prior Publication Data

US 2018/0282711 A1    Oct. 4, 2018

Related U.S. Application Data

(62) Division of application No. 14/555,326, filed on Nov. 26, 2014, now Pat. No. 9,994,828.

(60) Provisional application No. 61/909,289, filed on Nov. 26, 2013.

(51) Int. Cl.

| | | |
|---|---|---|
| C12N 15/82 | (2006.01) | |
| A23D 9/00 | (2006.01) | |
| C12N 9/12 | (2006.01) | |
| A23K 20/158 | (2016.01) | |
| C11B 1/00 | (2006.01) | |
| C11B 1/04 | (2006.01) | |
| C11B 1/10 | (2006.01) | |
| C12N 9/10 | (2006.01) | |

(52) U.S. Cl.
CPC ............ C12N 15/8247 (2013.01); *A23D 9/00* (2013.01); *A23K 20/158* (2016.05); *C11B 1/00* (2013.01); *C11B 1/04* (2013.01); *C11B 1/10* (2013.01); *C12N 9/1029* (2013.01); *C12N 9/1288* (2013.01); *C12N 15/82* (2013.01); *C12Y 203/01085* (2013.01)

(58) Field of Classification Search
None
See application file for complete search history.

(56) References Cited

U.S. PATENT DOCUMENTS

| 8,309,796 B2 | 11/2012 | Weaver et al. |
| 9,994,828 B2 * | 6/2018 | Walsh .................. C12N 9/1288 |
| 2010/0266564 A1 | 10/2010 | Apt |

FOREIGN PATENT DOCUMENTS

| RU | 2008125816 A | 12/2009 |
| WO | 2007106903 A2 | 9/2007 |
| WO | 2007106904 A2 | 9/2007 |
| WO | 2010108114 A2 | 9/2010 |
| WO | 2011146524 A1 | 11/2011 |
| WO | 2013016546 A2 | 1/2013 |

OTHER PUBLICATIONS

Metz, James G., et al., "Biochemical characterization of polyunsaturated fatty acid synthesis in schizochytrium: release of the products as free fatty acids," Plant physiology and biochemistry, Feb. 15, 2009, pp. 472-478, vol. 47, No. 6.
Naqvi, S. et al., "When more is better: multigene engineering in plants," Tends in Plant Sciences, Jan. 1, 2010, pp. 48-56, vol. 15, No. 1.
Egelkrout, Erin et al., "Overproduction of recombinant proteins in plants," Plant Science, Dec. 9, 20111, pp. 83-101, vol. 184, No. 9.
Peremarti et al., "Promoter diversity in multigene transformation," Plant Molecular Biology, Mar. 31, 2010, pp. 363-378, vol. 73, No. 4-5.
International Search and Written Opinion from International Application No. PCT/US2014/067729, dated Mar. 26, 2015, 39 pages.
International Preliminary Report on Patentability from International Application No. PCT/US2014/067729, dated Jun. 9, 2016, 28 pages.
Extended European Search Report from European Application No. 14866690.2, dated May 18, 2017, 9 pages.

* cited by examiner

*Primary Examiner* — Elizabeth F McElwain
(74) *Attorney, Agent, or Firm* — Magleby, Cataxinos & Greenwood, P.C.

(57) ABSTRACT

This disclosure concerns recombinant host organisms genetically modified with a polyunsaturated fatty acid (PUFA) synthase system and one or more accessory proteins that allow for and/or improve the production of PUFAs in the host organism. The disclosure also concerns methods of making and using such organisms as well as products obtained from such organisms.

19 Claims, 7 Drawing Sheets

Specification includes a Sequence Listing.

FIG. 4

PRODUCTION OF OMEGA 3 LONG CHAIN POLYUNSATURATED FATTY ACIDS IN OILSEED CROPS BY A THRAUSTOCHYTRID PUFA SYNTHASE

CROSS-REFERENCE TO RELATED APPLICATION

This application is a divisional of U.S. patent application Ser. No. 14/555,326 filed Nov. 26, 2014, now U.S. Pat. No. 9,994,828, issued Jun. 12, 2018, which claims the benefit of U.S. Provisional Application No. 61/909,289, filed Nov. 26, 2013, the contents of which are incorporated by reference herein.

FIELD OF THE DISCLOSURE

The present disclosure generally relates to recombinant host organisms (e.g., plants) genetically modified with a polyunsaturated fatty acid (PUFA) synthase system and one or more accessory proteins that allow for and/or improve the production of PUFAs in the host organism. The present invention also relates to methods of making and using such organisms (e.g., to obtain PUFAs) as well as products obtained from such organisms (e.g., oil and seed).

BACKGROUND

Polyunsaturated fatty acids (PUFAs) are considered to be useful for nutritional, pharmaceutical, and industrial applications, as well as other purposes. However, the current supply of PUFAs from natural sources (e.g., fish oils and algal oils) and from chemical synthesis is not sufficient or cost-effective for many long-term commercial needs.

Vegetable oils derived from plants (e.g., oil seed crops) are relatively inexpensive, do not have the contamination issues associated with fish oils, and are considered sustainable. However, the PUFAs found in commercially-developed plants and plant oils do not typically include more saturated or longer-chain PUFAs, and only typically include fatty acids such as linoleic acid (eighteen carbons with 2 double bonds, in the delta 9 and 12 positions—18:2 delta 9,12) and linolenic acid (18:3 delta 9,12,15).

The production of more unsaturated or longer-chain PUFAs in plants by the modification of the fatty acids endogenously produced by plants has been described. For example, the genetic modification of plants with various individual genes encoding fatty acid elongases and/or desaturases has been described as resulting in the generation of leaves or seeds containing significant levels of longer-chain and more unsaturated PUFAs, such as docosahexaenoic acid (DHA) and eicosapentaenoic acid (EPA), but also containing significant levels of mixed shorter-chain and less unsaturated PUFAs. Qi et al. (2004) Nature Biotech. 22:739; PCT International Patent Publication No. WO 04/071467; Abbadi et al. (2004) Plant Cell 16:1; Napier and Sayanova (2005) Proc. Nutr. Soc. 64:387-93; Robert et al. (2005) Functional Plant Biol. 32:473-79; U.S. Patent Publication No. 2004/0172682; Petrie et al. (2012) PLOS One 7:e49165; and U.S. Provisional Application No. 61/345,537 (filed May 17, 2010).

BRIEF SUMMARY OF THE DISCLOSURE

Described herein are methods and compositions that may be utilized to produce LC-PUFAs in transgenic host organisms (e.g., plant cells, plant parts, and plants), as well as quantities of non-natural plant lipids, for example, triacylglycerol (TAG) and phospholipids (PL) that are enriched in such PUFAs, and to produce them with longer backbones and with a greater degree of unsaturation than was previously available. Also described herein are systems for producing PUFAs in a host plant by providing a host organism that is genetically modified with a functional PUFA synthase system.

Some embodiments herein include a genetically modified plant cell (e.g., a canola, soy, and/or *Arabidopsis* plant cell) that comprises polynucleotide(s) encoding at least one polypeptide of polyunsaturated fatty acid (PUFA) synthase (PFA1, PFA2, and PFA3) from a Thraustochytrid *Schizochytrium* alga (a representative example of which is the *Schizochytrium* sp. as deposited under ATCC Accession No. PTA-9695) and a phosphopantetheinyl transferase (HetI) from the cyanobacteria genus, *Nostoc*, the expression products of which reconstitute a functional PUFA synthase system. For example, a plant cell may comprise polynucleotide(s) encoding *Schizochytrium* PFA1, PFA2, and PFA3; and *Nostoc* HetI. In some embodiments, the plant cell also comprises at least one polynucleotide encoding the acyl-CoA synthetase isozyme 2 (SzACS2). In particular embodiments, polynucleotide(s) encoding at least one DHA-preferring accessory protein are also expressed in a host plant cell to promote incorporation of LC-PUFA into seed oil (e.g., ACS, DGAT, LPAT, LPCAT, and PDAT).

Particular embodiments herein include a genetically modified plant (e.g., a *Brassica, Glycine, Arabidopsis*, and oilseed crop plant) comprising such a plant cell, as well as descendants, seeds, tissues, or parts thereof. In particular embodiments, the genetically modified plant cell is an oilseed crop plant cell; for example and without limitation, safflower, sunflower, and palm). A genetically modified oilseed crop plant cell expressing a functional PUFA synthase system may generate a characteristic fatty acid profile, for example, including DHA-containing vegetable oils.

Some embodiments provide polynucleotide(s) encoding components of the functional PUFA synthase system (e.g., *Schizochytrium* PFA1, PFA2, PFA3, and *Nostoc* HetI), and optionally, at least one accessory protein (e.g., SzACS2). In some examples, these polynucleotides are comprised in a single recombinant expression vector. In other examples, the polynucleotides are contained in different recombinant expression vectors.

In particular embodiments, polynucleotide(s) encoding the components of the functional PUFA synthase system, and optionally, at least one accessory protein, are operably linked to a seed-specific promoter. For example, the polynucleotide(s) may be operably linked in particular examples to a promoter selected from the group consisting of PvDlec2; PvPhas; LfKCS3; FAE1; BoACP; BnaNapinC; SSPRO2745.1; and SSPRO2743.1, which promoter elements are exemplified herein. In some embodiments, the polynucleotide(s) are operably linked to a constitutive promoter (e.g., ubiquitin and CsVMV promoters), or a leaf-specific promoter. Additional promoters may be employed in particular embodiments to drive expression of the functional PUFA synthase system during different stages of growth and/or at higher levels during seed development, for example, to provide increased accumulation of LC-PUFAs.

In other embodiments, the polynucleotide(s) encoding the components of the functional PUFA synthase encode a polypeptide comprising an amino acid sequence that is at least 80% identical to SEQ ID NO:1; a polypeptide comprising an amino acid sequence that is at least 80% identical to SEQ ID NO:4; and/or a polypeptide comprising an amino acid sequence that is at least 80% identical to SEQ ID NO:7 or SEQ ID NO:14, wherein the polynucleotide(s) also comprise a HetI gene (e.g., a polynucleotide encoding a polypeptide having at least 80% identity to the encoded product of SEQ ID NO:10). In some embodiments, the polynucleotide(s) also comprise a SzACS2 gene (e.g., a polynucleotide encoding a polypeptide having at least 80% identity to the encoded product of SEQ ID NO:11).

In particular examples, the polynucleotide(s) encoding the components of the functional PUFA synthase comprise a polynucleotide that is at least 70% identical to SEQ ID NO:2 and/or SEQ ID NO:3; a polynucleotide that is at least 70% identical to SEQ ID NO:5 and/or SEQ ID NO:6; a polynucleotide that is at least 70% identical to SEQ ID NO:8, SEQ ID NO:9, and/or SEQ ID NO:13; and/or a polynucleotide that encodes a polypeptide having at least 80% identity to SEQ ID NO:10. In certain examples, the polynucleotide(s) also comprise a polynucleotide that encodes a polypeptide having at least 80% identity to SEQ ID NO:11.

In particular examples, the polynucleotide(s) encoding the components of the functional PUFA synthase hybridize under stringent conditions (e.g., very stringent conditions) to SEQ ID NO:2 and/or SEQ ID NO:3; SEQ ID NO:5 and/or SEQ ID NO:6; SEQ ID NO:8, SEQ ID NO:9, and/or SEQ ID NO:13; SEQ ID NO:10; and/or SEQ ID NO:11. In certain examples, the polynucleotide(s) hybridize under stringent conditions to all of SEQ ID NO:2; SEQ ID NO:5; SEQ ID NO:8; SEQ ID NO:10; and SEQ ID NO:11.

Also described herein is a method for producing a transgenic plant, wherein the method comprises introducing polynucleotide(s) encoding the components of the functional PUFA synthase into a plant cell; and regenerating a plant from the plant cell. In some embodiments, the polynucleotide(s) are transformed into a crop plant cell in a single vector. In other embodiments, the polynucleotide(s) are transformed into a crop plant cell via multiple vectors to generate a plant containing constituent genes in different events. In some embodiments, the polynucleotide(s) are introduced into the crop plant cell by introgression via conventional breeding. A functional PUFA synthase system is reconstituted in particular examples by breeding crosses to optimize the PUFA profile of the progeny plants (e.g., by selecting for plants producing DHA (C22:6, n-3) and/or EPA (C20:5, n-3)).

In some embodiments, a genetically modified plant, a descendant, cell, tissue, seed, or part thereof, or a non-natural oil (e.g., a raw seed oil) obtained from the genetically modified plant, descendant, seed, cell, tissue, or part thereof comprises detectable amounts of DHA, DPA(n-6) (C22:5, n-6), and/or EPA. In particular embodiments, the genetically modified plant, descendant, cell, tissue, seed, or part or oil thereof comprises a fatty acid profile having between 0.01% and 15% DHA by weight (e.g., between 0.05% and 10% DHA; or 0.05% to 5% DHA by weight). In particular embodiments, the genetically modified plant, descendant, cell, tissue, seed, or part or oil thereof comprises a fatty acid profile having between 0.01% and 10% EPA by weight (e.g., between 0.05% and 5% EPA; or 0.05% to 1% EPA by weight). In particular embodiments, the genetically modified plant, descendant, cell, tissue, seed, or part or oil thereof comprises a fatty acid profile having between 0.01% and 10% DPA(n-6) by weight (e.g., between 0.01% and 5% DPA(n-6); or 0.01% to 1% DPA(n-6) by weight). In particular embodiments, the genetically modified plant, descendant, cell, tissue, seed, or part or oil thereof comprises a fatty acid profile having a ratio of EPA:DHA of from 10:1 to 1:30 (e.g., from about 2:1 to about 1:10, from about 1:1 to about 1:12, from about 2:1 to about 1:11, from about 1:1.5 to about 1:5, from about 6:1 to about 1:6.5, and about 1:1.25) by weight of total fatty acids. In particular embodiments, the genetically modified plant, descendant, cell, tissue, seed, or part or oil thereof comprises a fatty acid profile having a ratio of DPA(n-6):DHA of from 1:1 to 1:10 (e.g., from 1:2 to 1:5, from about 1:3 to about 1:5, about 1:3 to about 1:6, and about 1:5) by weight of total fatty acids. In particular embodiments, the genetically modified plant, descendant, cell, tissue, seed, or part or oil thereof comprises a fatty acid profile having from 70% to 99% triglycerides by weight of the oil.

In some embodiments, detectable amounts of DHA, DPA (n-6) and/or EPA are also found in a plant commodity product (e.g., oil product, specialty oil product, grain, and meal) obtained from the genetically modified plant. LC-PUFA-containing vegetable oils that are obtained from genetically modified plants described herein may be used as low cost sources of DHA/EPA for food ingredients toward improved human nutrition. Oils and oilseeds that are obtained from genetically modified plants described herein may be used as low cost, high quality ω-3 LC-PUFA sources for animal feed and aquaculture, or as feedstock for inter-esterification to build structured lipids enriched in ω-3 LC-PUFAs for pharmaceutical and nutraceutical uses.

Also described herein are methods for producing an oil comprising at least one LC-PUFA, wherein the method comprises growing a genetically modified plant (e.g., an oilseed plant), descendant, cell, tissue, or part thereof described herein, and/or recovering oil (e.g., a seed oil) from a genetically modified plant described herein.

Also described herein are methods for providing a supplement or therapeutic product containing at least one LC-PUFA to an individual, wherein the method comprises providing to the individual a genetically modified plant, descendant, cell, tissue, or part thereof described herein, an oil described herein, a seed described herein, a food product described herein, a functional food described herein, or a pharmaceutical product described herein. In some embodiments, a LC-PUFA contained in such embodiments is DHA, DPA(n-6), and/or EPA.

The foregoing and other features will become more apparent from the following detailed description of several embodiments, which proceeds with reference to the accompanying figures.

BRIEF DESCRIPTION OF THE FIGURES

FIG. 1a includes PUFA synthase constructs arranged in "Orientation 1."

FIG. 1b includes constructs arranged in "Orientation 2."

FIG. 1c includes constructs arranged in "Orientation 3."

FIG. 4 includes a graphical representation of LC-PUFA content of $T_3$ seed progeny from selected transgenic Arabi-

*dopsis* DHA-producing T₂ lines. Each circle represents T₃ seed from one homozygous T₂ plant. The gray bar represents the average LC-PUFA content for each T₃ seed line.

Figure 5:
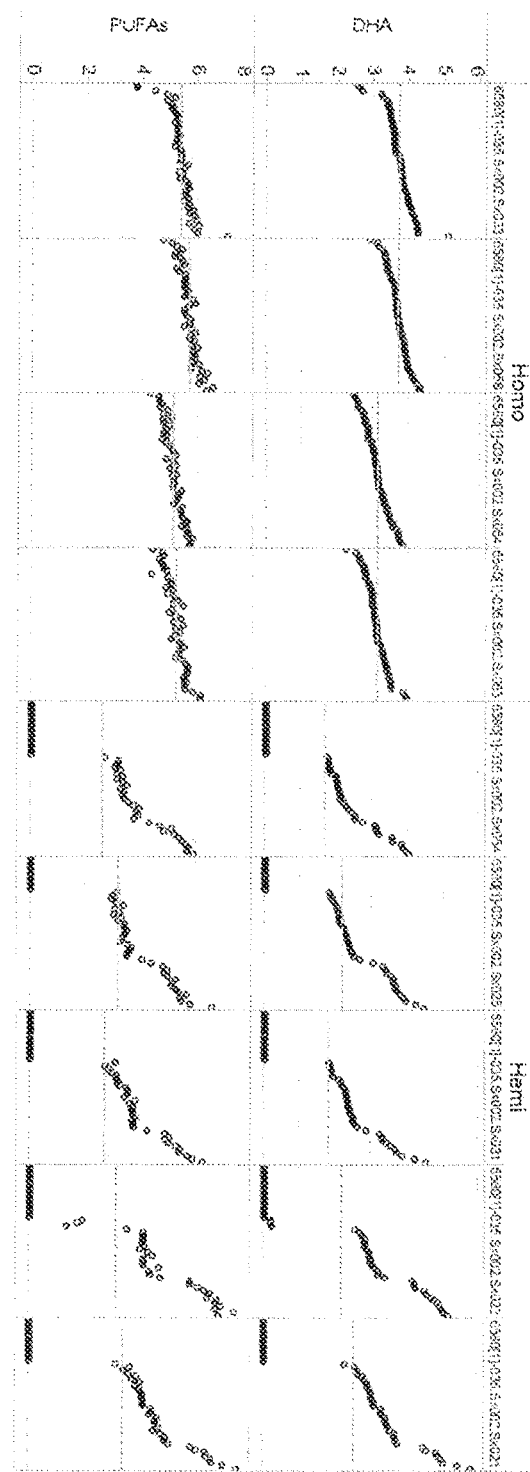

FIG. 5 includes a graphical representation of LC-PUFA content of individual T₂ seeds from four homozygous and five hemizygous T₁ canola plants. 48 seeds were analyzed per line. "PUFAs" represent the total of DHA+EPA+DPA (n=6). The ordinate axis corresponds to the LC-PUFA content as % of total FAMES.

SEQUENCE LISTING

The nucleic acid sequences listed in the accompanying sequence listing are shown using standard letter abbreviations for nucleotide bases, as defined in 37 C.F.R. § 1.822. Only one strand of each nucleic acid sequence is shown, but the complementary strand is understood to be included by any reference to the displayed strand. In the accompanying sequence listing:

SEQ ID NO:1 shows the amino acid sequence of an exemplary PFA1 protein:

MDTRIAIVGMSAILPSGENVRESWEAIRDGLDCLSDLPADRVDVTAYYNP
EKTTKDKIYCKRGGFIPEYDFDAREFGLNMFQMEDSDANQTISLLKVKEA
LTDANIPAFSSGKKNIGCVLGIGGGQKASHEFYSRLNYVVVDKVLRKMGL
PEEDVAAAVDKYKASFPEWRLDSFPGFLGNVTAGRCCNTFNMEGMNCVVD
AACASSLIAVKVAIEELLYGDCDAMIAGATCTDNSIGMYMAFSKTPVFST
DPSVKAYDAATKGMLIGEGSAMLVLKRYADAVRDGDTVHAVIKGCASSSD
GKAAGIYTPTISGQEEALRRAYARANVDPATVTLVEGHGTGTPVGDKIEL
TALSNLFSKAFSANGGGAEEAEQVAVGSIKSQIGHLKAVAGLAGLVKVVL
ALKHKTLPQTINVDKPPSLVDGTPIQQSPLYVNTMNRPWFTPVGVPRRAG
VSSFGFGGANYHAVLEEFEPEHESAYRYNNLPQVALLHAGDVATLAATVR
AKLALATAEQEEARVVKNADYIAYHRFLDECKLRGAVPQAHARVGLLVRD
LSSLIAVLEAAAAKLAGEESATEWTVSVATGEAAFRVRGVATEANVAALF
SGQGAQYTHMFSDVAMNWPPFRESVAAMDRAQRERFGRPAKRVSSVLYPR
KPYGDEPRQDHKEISQTRYSQPATLACSVGAFDIFKAAARAPSFAAGHSL
GEFAALYAAGSLDRDAVFDLVCARAKAMSDFTAQASSSGGAMAAVIGAKA
DQLSLGGAPDVWLANSNSPSQTVITGTAEAVAAASDKLRCSGNFRVVPLA
CEAAFHSPHMRGAEQTFASALAQAPVSAPAAARFYSNVTGGAAVTSPADV
KTNLGKHMTSPVQFVQQVRAMHAAGARVFVEFGPKQVLSRLVKETLGEAG
DVVTVAVNPDSAKDSDTQLRQAALTLAVAGVPLKDFDRWQLPDATRLEPV
KKKKTTLRLSAATYVSAKTLRQREAVLNDGYTVSGATAVVKEVDTANEER
LVRQAQDLQRQLAEASTAAQAAQSKVAELERTIQDLERKVQQQQQEKGEN
SDSNAAAEVLRRHKELLQRMLQDCDEQAVPVATVVPTPTSSPTPTSSPVS
GNSKSTRGSADLQALLAKAETVVMAVLAAKTGYEADMVEADMDLEAELGI
DSIKRVEILSEVQGQLGVEAKDVDALSRTRTVGEVVDAMKAEIVAASGGS
APAVPSAPAASAAPTPAASTAPSADLQALLSKAETVVMAVLAAKTGYEAD
MVEADMDLEAELGIDSIKRVEILSEVQGQLGVEAKDVDALSRTRTVGEVV
DAMKAEIVAASAGSAPAPAVPSAPAASAAPTPAASTAPSADLQALLSKAE
TVVMAVLAAKTGYEADMVEADMDLEAELGIDSIKRVEILSEVQGQLGVEA
KDVDALSRTRTVGEVVDAMKAEIVAASGGSAPAPAVPSAPAASAAPTPAA
ATAPSADLQALLAKAETVVMAVLAAKTGYEADMVEADMDLEAELGIDSIK
RVEILSEVQGQLGVEAKDVDALSRTRTVGEVVDAMKAEIVAASAGSAPAP
AVPSAPAASAAPTPAASTAPSADLQALLSKAETVVMAVLAAKTGYEADMV
EADMDLEAELGIDSIKRVEILSEVQGQLGVEAKDVDALSRTRTVGEVVDA
MKAEIVAASGGSAPAAAVPSAPAASAAPTPATAPSADLQALLSKAETVVM
AVLAAKTGYEADMVEADMDLEAELGIDSIKRVEILSEVQGQLGVEAKDVD
ALSRTRTVGEVVDAMKAEIVAASGGSAPAAPSAPALLPTLFGSECEDLSL
TFPVITTLPLPAELVLAEGGARPVVVVDDGSALTSSLVSSLGDRAVLLQV
QSSSACSPRSTTHKLVTVADRSEAALQAALTSVEAQFGKVGGFVFQFGDD
DVQAQLGWALLAAKHLKTSLSEQIEGGRTFFVAVARLDGQLGLSGKSTTA
TVDLSRAQQGSVFGLCKTLDLEWPAVFCRGIDLAADLDAAQAARCLLGEL
SDPDVAVRESGYSASGQRCTTTTKSLTTGKPHQPISSSDLFLVSGGARGI
TPLCVRELAQRVGGGTYVLIGRSELPTTEPAWAVGVESGKPLEKAALAFL
KAEFAAGRGAKPTPMLHKKLVGAVVGAREVRASLAEITAQGATAVYESCD
VSSAAKVREMVERVQQQGGRRVSGVFHASGVLRDKLVENKSLADFSAVYD
TKVGGLINLLACVDLAQLRHLVLFSSLAGFHGNVGQSDYAMANEALNKLA
AHLSAVHPQLCARSICFGPWDGGMVTPALKANFIRMGIQIIPRQGGAQTV
ANMLVSSSPGQLLVGNWGVPPVVPSATEHTVLQTLRQSDNPFLDSHVIQG
RRVLPMTLAVGYMAHQAQSIYAGHQLWAVEDAQLFKGIAIDNGADVPVRV
ELSRRKEEQEDAGKVKVKVQVLLKSQVNGKSVPAYKATVVLSPAPRPSVI
TRDFDLTPDPACTEHDLYDGKTLFHGKAFQGIEQVLSATPKQLTAKCRNL
PLTPEQRGQFVVNLSQQDPFQADIAFQAMLVWARMLRQSAALPNNCERFD
FYKPMAPGATYYTSVKLASASPLVDSVCKCTVAMHDEQGEVYFSARASVV
LNKTLTY

SEQ ID NO:2 shows the nucleotide sequence of an exemplary PFA1 gene, referred to herein as PFA1 v1, isolated from Thraustochytrid *Schizochytrium* sp. (as represented by ATCC Accession No. PTA-9695):

ATGGATACTCGCATCGCGATCGTGGGGATGTCGGCGATCCTGCCGAGCGG
GGAGAACGTGCGCGAGAGCTGGGAGGCGATCCGCGATGGCTGGATTGCC
TGAGCGATCTGCCGGCGGACCGCGTGGACGTGACGGCCTACTACAACCCG
GAGAAGACGACCAAGGACAAGATCTACTGCAAGCGCGGCGGGTTCATCCC
GGAGTACGACTTCGACGCGCGTGAGTTCGGGCTCAACATGTTCCAGATGG
AGGACTCGGACGCCAACCAGACGATCTCGCTGCTCAAGGTGAAGGAGGCG
CTGACGGACGCCAACATCCCGGCGTTCTCGAGCGGTAAGAAGAACATCGG
CTGCGTGCTGGGCATCGGCGGCGGCCAGAAGGCGAGCCACGAGTTCTACT
CGCGGCTCAACTACGTGGTCGTGGACAAGGTGCTGCGCAAGATGGGCCTG
CCGGAGGAAGACGTGGCGGCGGCGGTGGACAAGTACAAGGCGAGTTTCCC
CGAGTGGCGCCTCGACTCTTTCCCCGGGTTCCTGGGCAACGTCACGGCGG

```
GGCGCTGCTGCAATACCTTCAACATGGAGGGCATGAACTGCGTCGTGGAC
GCGGCCTGCGCGTCGTCGCTGATCGCGGTCAAAGTGGCGATCGAGGAGCT
GCTCTACGGCGACTGCGATGCGATGATCGCGGGTGCCACCTGCACGGACA
ACTCGATCGGGATGTACATGGCCTTCTCCAAGACGCCCGTGTTTTCCACG
GACCCGAGCGTCAAGGCGTACGACGCCGCCACCAAAGGCATGCTCATCGG
CGAGGGCTCGGCGATGCTCGTGCTGAAGCGCTACGCGGACGCCGTGCGCG
ACGGCGACACCGTGCACGCCGTCATCAAGGGGTGCGCGTCCTCGAGCGAC
GGCAAGGCGGCGGGCATCTACACGCCGACAATCTCGGGCCAGGAGGAGGC
CCTGCGCCGCGCCTACGCCCGCGCCAATGTCGACCCGGCCACTGTGACGC
TGGTGGAGGGCCACGGCACGGGTACGCCGGTGGGCGACAAGATCGAGCTG
ACGGCGCTGAGCAACCTCTTCTCCAAGGCGTTTTCTGCCAACGGTGGCGG
CGCGGAGGAAGCAGAGCAGGTGGCGGTGGGCAGCATCAAGTCGCAGATCG
GGCACCTCAAGGCGGTGGCCGGGCTGGCCGGGCTGGTCAAGGTGGTGCTG
GCGCTCAAGCACAAGAGCTGCCGCAGACGATCAACGTCGACAAGCCGCC
GTCGCTGGTGGACGGGACCCCGATCCAGCAGTCGCCGCTGTACGTCAACA
CGATGAACCGCCCCTGGTTCACGCCCGTAGGGGTGCCGCGCCGCGCCGGC
GTGTCGTCGTTTGGGTTTGGCGGTGCCAACTACCACGCCGTGCTGGAGGA
GTTTGAGCCCGAGCACGAGAGCGCGTACCGGTACAACAACCTGCCGCAGG
TGGCGCTGCTGCACGCGGGGACGTCGCGACCTTGGCGGCGACGGTTCGC
GCCAAGCTGGCGCTGGCCACCGCCGAGCAGGAAGAGGCGCGTGTGGTGAA
GAACGCGGACTACATCGCGTACCACCGGTTCCTGGACGAGTGCAAGTTGC
GCGGCGCTGTGCCGCAGGCGCACGCGGGTGGGACTGCTCGTACGGGAC
CTGAGCTCGCTCATCGCCGTGCTCGAGGCCGCTGCCGCCAAGCTCGCGGG
CGAAGAGAGCGCGACGGAGTGGACGGTCAGCGTTGCTACGGGCGAGGCGG
CCTTCCGCGTGCGCGGTGTGGCTACGGAGGCCAACGTGGCGGCGCTGTTC
TCGGGCCAGGGCGCGCAGTACACGCACATGTTCAGCGACGTGGCGATGAA
CTGGCCCCCGTTCCGCGAGAGCGTCGCCGCCATGGACCGCGCCCAGCGCG
AGCGCTTCGGGCGGCCTGCCAAGCGCGTGAGCAGCGTGCTGTACCCGCGC
AAGCCGTACGGCGACGAACCGCGGCAGGACCACAAGGAGATCTCGCAAAC
GCGCTACTCGCAGCCCGCAACGCTCGCGTGCTCGGTCGGCGCCTTTGACA
TCTTCAAAGCGGCGGGACTGGCGCCGAGCTTTGCGGCGGGCCACTCGCTG
GGCGAGTTTGCGGCGCTCTACGCGGCCGGGTCGCTCGATCGCGACGCCGT
CTTCGACCTGGTCTGCGCGCGCGCCAAGGCCATGAGCGACTTCACGGCCC
AGGCCAGCAGCAGCGGTGGCGCCATGGCGGCCGTGATTGGCGCCAAGGCG
GACCAGCTCTCGCTGGGTGGCGCGCCCGACGTGTGGCTCGCCAACAGCAA
CTCGCCCTCGCAGACCGTGATCACGGGAACCGCCGAAGCAGTGGCTGCGG
CCTCTGACAAGTTGCGCTGCAGCGGCAACTTCCGCGTCGTGCCTCTGGCC
TGCGAGGCGGCCTTCCACTCGCCGCACATGCGCGGCGGAGCAGACGTT
TGCGTCGGCGCTCGCGCAGGCGCCCGTGTCGGCACCGGCGGCTGCTCGGT
TCTACTCTAACGTGACGGGGGGCGCCGCGGTAACCTCGCCCGCGGACGTC
AAAACGAACCTGGGCAAGCACATGACGAGCCCTGTGCAGTTCGTGCAGCA
GGTGCGAGCCATGCACGCGGCGGGCGCGCGTGTGTTTGTGGAGTTTGGGC
CCAAGCAGGTCCTGTCGCGCCTCGTCAAGGAGACCCTTGGCGAGGCCGGC
GACGTGGTCACGGTCGCCGTCAACCCAGACTCGGCCAAGGACAGCGACAC
GCAGCTGCGCCAGGCGGCGCTCACGTTGGCGGTCGCCGGCGTGCCGCTCA
AGGACTTTGACCGCTGGCAGCTGCCGGATGCCACGCGCCTCGAGCCTGTC
AAGAAGAAGAAGACCACGTTGCGGCTCTCGGCAGCCACCTACGTCTCCGC
CAAGACGTTGCGCCAGCGCGAGGCCGTGCTCAACGACGGCTACACTGTCA
GTGGTGCCACGGCGGTAGTCAAGGAAGTGGACACGGCCAACGAGGAGCGT
CTCGTCCGCCAAGCCCAGGATCTCCAGCGCCAGCTCGCGGAGGCCTCGAC
GGCAGCCCAGGCGGCGCAGTCCAAGGTCGCGGAGCTCGAGCGCACGATCC
AGGACTTGGAGCGCAAGGTGCAGCAGCAGCAGCAAGAGAAGGGTGAGAAC
TCAGACAGCAACGCTGCCGCCGAAGTGCTGCGGCGCCACAAGGAGCTGCT
CCAGCGCATGCTGCAGGACTGTGACGAGCAGGCAGTGCCCGTAGCCACGG
TGGTTCCGACACCTACGTCCTCCCCGACGCCTACATCCTCACCCGTATCC
GGCAACAGCAAGAGCACTCGTGGCAGTGCTGATCTGCAAGCGCTGCTGGC
CAAGGCGGAGACTGTGGTGATGGCTGTGCTGGCTGCCAAGACTGGCTACG
AGGCCGACATGGTTGAGGCGGACATGGACCTGGAGGCCGAGCTCGGCATC
GACTCGATCAAGCGCGTGGAGATCCTTTCCGAGGTGCAGGGCCAGCTGGG
CGTCGAGGCCAAGGACGTGGATGCGCTGAGCCGCACGCGCACGGTCGGTG
AGGTTGTGGACGCCATGAAGGCGGAGATCGTGGCTGCCTCTGGTGGTAGT
GCTCCTGCGGTTCCTTCGGCGCCCGCTGCTTCTGCAGCTCCGACTCCCGC
TGCTTCGACTGCGCCTTCTGCTGATCTGCAAGCGCTGCTGTCCAAGGCGG
AGACTGTGGTGATGGCTGTGCTGGCGGCCAAGACTGGCTACGAGGCCGAC
ATGGTCGAGGCGGACATGGACCTGGAGGCCGAGCTCGGCATCGACTCGAT
CAAGCGCGTGGAGATCCTCTCGGAGGTGCAGGGCCAGCTGGGCGTCGAGG
CCAAGGACGTGGATGCGCTGAGCCGCACGCGCACGGTCGGTGAGGTTGTG
GATGCCATGAAGGCGGAAATCGTGGCTGCCTCTGCTGGTAGTGCTCCTGC
TCCTGCTGTTCCTTCGGCGCCCGCTGCTTCTGCAGCTCCGACTCCCGCTG
CTTCGACTGCGCCTTCTGCTGATCTGCAAGCGCTGCTGTCCAAGGCGGAG
ACGGTGGTGATGGCTGTGCTGGCGGCCAAGACTGGCTACGAGGCCGACAT
GGTCGAGGCGGACATGGACCTGGAGGCCGAGCTCGGCATCGACTCGATCA
AGCGCGTGGAGATCCTCTCGGAGGTGCAGGGCCAGCTGGGCGTCGAGGCC
AAGGACGTGGATGCGCTGAGCCGCACGCGCACGGTCGGTGAGGTTGTGGA
TGCCATGAAGGCGGAAATCGTGGCTGCCTCTGGTGGTAGTGCTCCTGCTC
CTGCGGTTCCTTCGGCGCCCGCTGCTTCTGCAGCTCCGACTCCCGCGGCT
GCGACAGCGCCTTCTGCTGATCTGCAAGCGCTGCTGGCCAAGGCGGAGAC
TGTGGTGATGGCTGTGCTGGCGGCCAAGACTGGCTACGAGGCCGACATGG
TCGAGGCGGACATGGACCTGGAGGCCGAGCTCGGCATCGACTCGATCAAG
CGCGTGGAGATCCTTTCCGAGGTGCAGGGCCAGCTGGGCGTCGAGGCCAA
GGACGTAGATGCGCTGAGCCGCACGCGCACGGTCGGTGAGGTTGTGGATG
```

-continued

```
CCATGAAGGCGGAGATCGTGGCTGCCTCTGCTGGTAGTGCTCCTGCTCCT
GCTGTTCCTTCGGCGCCCGCTGCTTCTGCAGCTCCGACTCCCGCTGCTTC
GACTGCGCCTTCTGCTGATCTGCAAGCGCTGCTGTCCAAGGCGGAGACTG
TGGTGATGGCTGTGCTGGCGGCCAAGACTGGCTACGAGGCCGACATGGTC
GAGGCGGACATGGACCTGGAGGCCGAGCTCGGCATCGACTCGATCAAGCG
CGTGGAGATCCTCTCGGAGGTGCAGGGCCAGCTGGGCGTCGAGGCCAAGG
ACGTGGATGCGCTGAGCCGCACGCGCACGGTCGGTGAGGTTGTGGATGCC
ATGAAGGCGGAAATCGTGGCTGCCTCTGGTGGTAGTGCTCCTGCTGCTGC
TGTTCCTTCGGCGCCCGCTGCTTCTGCAGCTCCGACTCCTGCGACTGCGC
CTTCTGCTGATCTGCAAGCGCTGCTGTCCAAGGCGGAGACTGTGGTGATG
GCTGTGCTGGCGGCCAAGACTGGCTACGAGGCCGACATGGTCGAGGCGGA
CATGGACCTGGAGGCCGAGCTCGGCATCGACTCGATCAAGCGCGTGGAGA
TCCTTTCCGAGGTGCAGGGCCAGCTGGGCGTCGAGGCCAAGGACGTAGAT
GCGCTGAGCCGCACGCGCACGGTCGGTGAAGTGGTGGACGCCATGAAGGC
GGAGATCGTGGCTGCCTCTGGTGGTAGTGCTCCTGCTGCTCCTTCGGCGC
CCGCGCTTCTTCCAACGCTGTTTGGTTCCGAGTGCGAGGACCTGTCTCTG
ACCTTTCCCGTGATAACGACCCTGCCGCTTCCTGCAGAGCTTGTGCTGGC
CGAGGGCGGCGCTCGCCCTGTAGTCGTGGTGGATGATGGATCTGCACTCA
CCTCGTCGCTGGTGTCCTCGCTCGGCGATCGTGCGGTGCTGCTGCAGGTG
CAGTCTTCCTCTGCCTGCTCGCCGCGCTCGACCACGCACAAGTTGGTGAC
CGTAGCAGACCGCTCTGAAGCGGCGCTACAGGCGGCGCTCACGTCCGTCG
AGGCGCAGTTCGGCAAGGTGGGTGGCTTTGTGTTCCAGTTCGGCGACGAC
GACGTGCAAGCGCAGCTCGGCTGGGCGCTGCTCGCGGCCAAGCACCTCAA
AACTTCGCTGTCAGAACAGATCGAGGGCGGTCGCACCTTTTTCGTGGCCG
TCGCGCGGCTCGACGGCCAGCTGGGGCTCTCCGGCAAGTCGACGACCGCT
ACCGTTGATCTCTCCCGCGCGCAGCAGGGCAGCGTGTTCGGCCTGTGCAA
GACACTCGACCTGGAGTGGCCCGCTGTCTTCTGCCGCGGAATCGACCTGG
CCGCCGACCTCGACGCCGCACAGGCCGCGCGGTGCCTGCTGGGCGAGCTG
TCAGACCCCGACGTGGCCGTGCGCGAGTCTGGTTACTCCGCCTCGGGCCA
GCGCTGCACGACAACTACGAAGTCGCTGACTACGGGCAAGCCGCACCAGC
CGATCTCCTCGTCGGACCTCTTTCTGGTGTCGGCGGCGCGCGCGGCATC
ACCCCGCTGTGCGTGCGCGAGCTGGCGCAGCGCGTGGGCGGCGGCACGTA
CGTGCTCATCGGCCGCTCGGAGCTGCCCACGACGGAGCCTGCCTGGGCGG
TCGGCGTGGAGTCTGGCAAGCCGCTGGAGAAGGCCGCGCTGGCGTTCCTG
AAGGCGGAGTTTGCAGCGGGCCGCGGGGCAAGCCGACGCCGATGCTGCA
CAAGAAGCTCGTGGGCGCCGTGGTCGGAGCGCGCGAGGTGCGAGCCTCGC
TCGCCGAGATCACTGCACAGGGCGCCACGGCTGTGTACGAGTCGTGCGAC
GTGAGCTCTGCCGCCAAGGTGCGTGAGATGGTAGAGCGCGTGCAGCAGCA
GGGCGGGCGGCGCGTGTCGGGCGTGTTCCACGCGTCGGGCGTGCTGCGCG
ACAAGCTCGTGGAGAACAAGTCGCTGGCGGACTTCAGCGCCGTGTACGAC
ACCAAGGTGGGCGGCCTCATCAACCTGCTGGCCTGCGTGGACCTGGCGCA
GCTGCGTCACCTCGTGCTCTTCAGCTCGCTCGCGGGCTTCCACGGCAACG
TCGGGCAGTCGGACTACGCAATGGCCAACGAGGCGCTCAACAAGCTGGCG
GCGCACCTGTCGGCGGTGCACCCGCAGCTGTGCGCGCGCTCGATCTGCTT
CGGACCGTGGGACGGCGGCATGGTGACCCCCGCGCTCAAGGCCAACTTCA
TCCGCATGGGCATCCAGATCATCCCGCGCCAAGGCGGCGCGCAGACCGTC
GCCAACATGCTCGTCAGTAGCTCCCCCGGTCAGCTGCTCGTGGGCAACTG
GGGCGTGCCACCCGTCGTGCCGAGTGCCACCGAGCACACCGTGCTGCAGA
CGCTCCGCCAGAGCGACAACCCCTTCCTCGACTCGCACGTGATCCAGGGC
CGCCGCGTGCTGCCCATGACCCTGGCCGTGGGCTACATGGCGCACCAGGC
GCAGAGCATCTACGCGGGCCACCAGCTGTGGGCCGTCGAGGACGCCCAGC
TCTTCAAGGGCATCGCCATCGACAATGGCGCCGACGTGCCCGTGCGCGTG
GAGCTGTCGCGCCGCAAGGAGGAGCAGGAGGACGCCGGCAAGGTCAAGGT
CAAGGTGCAGGTGCTGCTCAAATCGCAGGTCAACGGCAAGTCGGTGCCCG
CGTACAAGGCGACCGTCGTGCTGTCCCCTGCGCCGCGCCCCAGCGTCATC
ACGCGTGACTTCGACCTCACCCCGGACCCGGCCTGCACGGAGCACGACCT
CTACGACGGCAAGACGCTCTTCCACGGCAAGGCCTTCCAGGGCATCGAGC
AGGTGCTCTCGGCGACGCCCAAGCAGCTCACCGCCAAGTGCCGCAATTTG
CCCCTCACGCCCGAGCAGCGCGGCCAGTTCGTCGTTAACCTCAGCCAGCA
GGACCCGTTCCAGGCGGACATTGCGTTCCAGGCGATGCTCGTCTGGGCGC
GCATGCTGCGCAATCGGCGGCCCTGCCCAACAACTGCGAGCGCTTCGAC
TTTTACAAGCCGATGGCCCCGGGCGCCACCTACTACACGTCGGTCAAGCT
GGCCTCGGCCTCACCCTTGGTGGACTCTGTGTGCAAGTGCACCGTGGCGA
TGCACGATGAGCAAGGTGAGGTGTACTTTTCTGCTCGTGCCAGCGTCGTC
CTCAACAAGACCCTCACGTACTAA
```

SEQ ID NO:3 shows the nucleotide sequence of an exemplary plant-optimized PFA1 gene, referred to herein as PFA1 v2:

```
ATGGATACCAGAATTGCCATTGTGGGAATGAGTGCGATCCTTCCGAGTGG
TGAGAATGTTAGAGAGAGCTGGGAGGCCATCAGAGATGGCTTGGATTGTC
TGTCTGATCTGCCTGCGGATCGTGTGGATGTGACTGCCTATTACAATCCA
GAGAAAACGACCAAGGACAAAATCTACTGCAAAAGAGGTGGGTTCATCCC
TGAGTATGACTTTGATGCTCGTGAGTTTGGCCTCAACATGTTCCAGATGG
AAGATTCTGATGCGAACCAGACCATCTCATTGCTCAAGGTGAAGGAAGCT
CTCACCGATGCCAACATACCTGCTTTCTCAAGTGGCAAAAGAACATTGG
TTGTGTTCTTGGCATAGGTGGAGGTCAGAAGGCGTCACATGAGTTCTACT
CCAGACTCAACTATGTTGTGGTTGACAAAGTGCTCAGAAAGATGGGTTTG
CCAGAGGAAGATGTGGCAGCTGCGGTGGACAAGTACAAGGCGAGCTTCCC
AGAGTGGAGGCTTGATTCTTTTCCTGGTTTCTTGGGCAATGTTACCGCTG
GCAGATGTTGCAACACCTTCAACATGGAGGGCATGAACTGTGTCGTTGAC
GCTGCCTGTGCTTCAAGCCTGATTGCGGTCAAGGTGGCAATAGAAGAGCT
```

-continued

TCTCTATGGTGACTGTGATGCCATGATTGCTGGTGCCACCTGCACAGACA
ATTCAATAGGGATGTACATGGCCTTCTCCAAGACGCCTGTTTTCTCTACG
GACCCGAGTGTCAAAGCGTATGATGCTGCCACCAAAGGCATGTTGATTGG
TGAAGGATCTGCGATGCTTGTTCTGAAGAGATATGCGGATGCTGTCAGAG
ATGGTGACACTGTTCATGCTGTCATCAAGGGCTGTGCTTCCTCAAGTGAT
GGAAAAGCAGCTGGAATCTACACACCGACAATCAGCGGACAAGAAGAGGC
TCTCCGTAGAGCCTATGCACGTGCCAATGTGGACCCAGCCACTGTCACTC
TTGTTGAAGGACATGGAACTGGCACTCCGGTTGGGGACAAGATTGAACTC
ACAGCTCTGAGCAATCTCTTCTCCAAAGCGTTTTCTGCGAATGGAGGTGG
AGCTGAGGAAGCTGAGCAAGTTGCTGTTGGCAGCATCAAGAGCCAGATAG
GGCACCTCAAAGCGGTTGCTGGATTGGCTGGATTGGTCAAAGTGGTCCTT
GCTCTCAAGCACAAGACATTGCCTCAGACGATCAATGTGGACAAGCCACC
TTCACTGGTGGATGGGACACCGATTAACAGTCCCCTTTGTACGTCAACA
CCATGAACCGTCCCTGGTTCACTCCGGTTGGGGTTCCGAGGAGAGCTGGC
GTTTCCTCATTTGGTTTTGGAGGTGCGAACTACCATGCTGTGCTTGAAGA
GTTTGAACCTGAACATGAGAGTGCTTACCGTTACAACAATCTTCCCCAAG
TTGCTCTCCTTCATGCTGGGGATGTTGCAACTCTTGCTGCCACAGTTAGG
GCAAAACTGGCATTGGCCACTGCTGAGCAAGAAGAGGCTAGAGTTGTGAA
GAACGCTGATTACATTGCATACCATAGGTTCCTTGATGAATGTAAGTTGA
GAGGAGCTGTTCCCCAAGCCCACGCAAGGGTTGGACTTCTGGTGAGGGAC
CTGTCCTCTCTCATTGCGGTTTTGGAAGCAGCTGCAGCCAAACTTGCTGG
AGAAGAGTCAGCAACGGAATGGACGGTCTCAGTTGCCACTGGTGAGGCTG
CATTCAGAGTTAGGGGTGTTGCCACAGAGGCCAATGTTGCTGCACTTTTC
TCTGGCCAAGGAGCGCAGTACACTCACATGTTCTCAGATGTTGCCATGAA
CTGGCCTCCGTTCAGAGAGAGTGTTGCTGCGATGGACAGAGCGCAGAGAG
AACGTTTTGGGAGGCCAGCCAAAAGAGTCTCCAGTGTTCTCTATCCGAGA
AAACCTTATGGAGATGAGCCAAGGCAAGATCACAAAGAGATTTCTCAGAC
GCGTTACTCTCAGCCAGCAACCCTCGCTTGCTCTGTCGGTGCCTTTGACA
TCTTCAAAGCAGCTGGATTGGCTCCTTCTTTTGCAGCTGGACATTCCCTG
GGAGAGTTTGCAGCTCTCTATGCAGCTGGTTCATTGGATCGTGATGCTGT
GTTTGACTTGGTTTGCGCTAGGGCAAAGGCCATGTCTGATTTCACTGCTC
AAGCCAGCTCCAGTGGAGGTGCTATGGCAGCGGTCATAGGAGCCAAGGCT
GATCAGCTCAGCCTTGGTGGAGCACCTGATGTTTGGCTGGCCAATAGCAA
CAGTCCATCACAGACGGTGATCACGGGAACTGCTGAAGCAGTGGCAGCTG
CATCTGACAAACTTCGTTGTAGTGGAAACTTCAGAGTGGTTCCTCTTGCT
TGTGAAGCTGCCTTCCATTCACCACACATGCGTGGAGCAGAGCAGACATT
TGCGTCTGCGCTTGCTCAAGCTCCAGTGTCCGCACCTGCAGCTGCCAGAT
TCTACAGCAACGTCACTGGTGGAGCTGCAGTCACCTCTCCTGCTGATGTC
AAAACGAACCTTGGGAAACACATGACTTCTCCTGTGCAGTTTGTGCAGCA
AGTCCGTGCCATGCACGCAGCTGGAGCAAGGGTGTTTGTTGAGTTCGGTC

-continued

CCAAGCAAGTCCTTTCTCGTTTGGTCAAAGAGACCCTTGGGGAAGCTGGA
GACGTGGTCACGGTGGCTGTCAACCCAGACTCAGCCAAGGATTCAGACAC
CCAGCTGAGACAAGCAGCTCTCACCTTGGCTGTGGCTGGTGTTCCACTCA
AAGACTTTGACAGATGGCAGCTTCCCGATGCCACTCGTCTTGAGCCTGTC
AAGAAAAAGAAAACAACCTTGAGGTTGAGTGCTGCCACCTATGTCTCTGC
CAAGACCTTGAGGCAGAGGGAGGCTGTGCTCAATGATGGTTACACTGTGA
GTGGTGCCACAGCGGTTGTCAAAGAAGTGGACACTGCAAACGAAGAGAGA
CTTGTCAGACAAGCACAAGACCTCCAGCGTCAGCTTGCTGAAGCAAGCAC
TGCAGCCCAAGCAGCTCAATCCAAGGTCGCTGAATTGGAGAGGACAATCC
AAGACTTGGAGAGGAAGGTTCAACAGCAACAGCAAGAGAAAGGTGAGAAC
TCTGACTCCAATGCAGCTGCGGAAGTGCTTAGGAGACACAAGGAACTGCT
CCAGAGGATGCTCCAAGATTGTGATGAGCAAGCAGTTCCCGTGGCAACAG
TCGTTCCAACACCCACTTCTTCCCCTACACCAACATCCTCACCAGTTAGC
GGAAACAGCAAGTCCACCAGAGGATCAGCCGACCTCCAAGCACTCCTGGC
GAAAGCTGAGACGGTCGTGATGGCAGTTTTGGCTGCAAAGACTGGCTACG
AGGCAGACATGGTGGAAGCAGATATGGATTTGGAGGCTGAGCTTGGGATT
GATTCCATCAAAGGGTGGAGATCCTGAGTGAAGTCCAAGGGCAGCTCGG
AGTTGAAGCGAAGGATGTTGATGCCCTTTCACGTACAAGGACCGTCGGAG
AGGTTGTGGATGCCATGAAGGCTGAGATTGTTGCTGCATCTGGTGGGTCA
GCACCTGCTGTCCCCTCTGCACCAGCTGCATCAGCGGCTCCGACACCTGC
TGCGAGTACCGCTCCGAGTGCTGATCTTCAGGCTCTCCTGTCTAAAGCCG
AGACGGTTGTGATGGCTGTGCTCGCAGCGAAAACTGGTTACGAGGCTGAC
ATGGTGGAAGCTGACATGGACCTTGAAGCGGAGTTGGGAATAGATAGCAT
CAAACGTGTTGAAATCTTGTCTGAGGTCCAAGGACAGTTGGGTGTGGAAG
CCAAAGATGTCGATGCGCTTTCAAGAACCAGAACCGTCGGTGAGGTCGTG
GACGCCATGAAGGCTGAGATTGTGGCTGCCTCTGCTGGCTCCGCTCCTGC
TCCAGCAGTTCCTTCTGCACCTGCAGCGTCAGCGGCTCCAACTCCAGCTG
CATCCACGGCTCCTTCTGCAGACCTCCAAGCCTTGCTGTCCAAAGCCGAA
ACAGTTGTGATGGCTGTCCTTGCTGCAAAGACTGGTTACGAAGCCGACAT
GGTTGAAGCTGACATGGATTTGGAAGCCGAACTTGGAATAGATTCCATCA
AAAGAGTGGAGATACTCTCTGAGGTGCAAGGTCAGCTCGGAGTTGAAGCG
AAAGACGTTGATGCCCTCAGTAGGACCAGAACTGTTGGGGAAGTTGTCGA
TGCGATGAAGGCTGAGATTGTCGCTGCCAGCGGTGGATCTGCACCTGCAC
CTGCGGTCCCGTCAGCTCCAGCAGCCAGCGCAGCTCCGACTCCTGCAGCT
GCCACAGCACCGAGTGCGGATCTGCAGGCATTGCTTGCGAAGGCTGAAAC
AGTTGTCATGGCTGTCCTGGCTGCGAAAACTGGCTATGAGGCTGATATGG
TGGAAGCCGACATGGACCTTGAGGCTGAATTGGGCATTGACAGCATCAAG
CGTGTTGAGATTCTCAGTGAAGTCCAAGGACAGCTCGGAGTGGAGGCGAA
GGATGTGGATGCCCTCTCAAGGACCAGAACAGTTGGTGAGGTCGTTGATG
CGATGAAGGCAGAGATTGTTGCTGCCAGTGCTGGTTCTGCTCCCGCACCC
GCTGTCCCAAGCGCACCAGCTGCCTCCGCCGCTCCCACACCAGCTGCCTC

-continued

```
TACTGCACCAAGTGCGGACCTTCAAGCTCTCCTGAGCAAGGCTGAGACAG
TTGTGATGGCAGTCCTTGCTGCGAAAACTGGCTATGAGGCAGACATGGTG
GAAGCGGACATGGATCTGGAAGCTGAACTTGGAATTGACTCCATCAAACG
TGTTGAAATCCTCTCTGAGGTTCAAGGTCAGCTTGGGGTGGAGGCCAAAG
ATGTTGATGCTCTTTCCAGAACAAGGACGGTGGGAGAGGTGGTTGATGCC
ATGAAGGCTGAGATAGTGGCAGCGTCAGGAGGGTCAGCACCTGCAGCTGC
CGTTCCGTCCGCACCAGCAGCCTCTGCAGCTCCCACGCCAGCCACCGCTC
CTAGTGCTGATTTGCAAGCCCTCCTTTCAAAAGCTGAAACTGTTGTCATG
GCTGTTTTGGCTGCCAAGACTGGCTACGAGGCTGACATGGTTGAGGCTGA
CATGGACTTGGAAGCCGAGCTTGGGATTGATAGCATCAAGCGTGTGGAAA
TCCTTTCTGAGGTTCAAGGTCAGCTGGGTGTTGAGGCCAAAGATGTCGAT
GCGTTGTCAAGGACCAGAACGGTTGGAGAAGTGGTCGATGCCATGAAGGC
TGAGATAGTTGCTGCCTCTGGAGGTTCAGCTCCTGCAGCTCCGTCAGCAC
CTGCCCTCCTTCCAACTTTGTTTGGTTCTGAGTGTGAAGATTTGAGCTTG
ACTTTCCCAGTCATCACAACCCTGCCTCTTCCTGCTGAACTTGTGCTGGC
TGAAGGTGGAGCACGTCCTGTGGTTGTGGTTGACGATGGCTCTGCACTCA
CCAGTTCTCTTGTGTCCTCACTTGGTGATCGTGCTGTGCTCTTGCAAGTT
CAGTCCAGCTCTGCCTGTTCACCCAGAAGCACCACGCACAAGTTGGTCAC
TGTTGCAGACCGTTCTGAAGCTGCATTGCAAGCTGCGCTCACATCAGTTG
AAGCACAGTTTGGAAAAGTGGGAGGTTTTGTGTTCCAGTTTGGTGATGAC
GATGTCCAAGCGCAGCTTGGTTGGGCACTGCTTGCTGCCAAACATCTCAA
AACGTCCTTGTCAGAACAGATAGAAGGTGGGAGGACCTTCTTTGTTGCCG
TTGCGAGGTTGGATGGTCAGTTGGGGTTGTCTGGAAAGTCCACGACTGCC
ACTGTTGATCTCTCCAGAGCGCAGCAAGGCTCAGTCTTTGGACTCTGCAA
AACCCTTGACTTGGAATGGCCTGCTGTTTTCTGCAGAGGAATCGACCTTG
CAGCTGACTTGGATGCTGCACAAGCTGCCAGATGTCTTTTGGGTGAGCTT
TCAGACCCAGATGTGGCAGTGAGGGAGTCTGGTTACTCCGCATCTGGGCA
AAGATGCACCACAACCACAAAGTCTCTCACCACGGGAAAACCACATCAAC
CGATCTCTTCCAGTGATTTGTTCCTGGTCTCTGGAGGTGCTCGTGGAATC
ACACCTCTTTGTGTGAGAGAATTGGCACAGAGGGTGGGAGGTGGAACCTA
TGTCCTCATTGGGAGAAGTGAGCTGCCCACCACGGAACCTGCCTGGGCTG
TTGGTGTTGAGTCAGGGAAACCTCTTGAGAAGGCTGCGCTGGCGTTCCTC
AAAGCTGAGTTTGCAGCTGGAAGGGGAGCGAAGCCGACACCGATGCTCCA
CAAGAAACTTGTTGGAGCTGTTGTGGGAGCTAGAGAGGTCCGTGCGAGCC
TGGCAGAGATAACTGCTCAAGGTGCCACAGCTGTCTATGAGTCCTGTGAT
GTCAGCTCTGCAGCCAAGGTTCGTGAAATGGTTGAGAGGGTTCAACAGCA
AGGAGGGAGAAGGGTCAGCGGTGTGTTTCATGCAAGTGGTGTTTTGAGAG
ACAAGTTGGTTGAGAACAAGTCACTGGCTGATTTCAGTGCTGTGTATGAC
ACAAAGGTTGGTGGACTCATCAACCTCCTTGCCTGTGTGGATCTTGCACA
GCTTAGGCACCTGGTGCTCTTCAGCTCCCTTGCTGGGTTCCACGGCAATG
TTGGTCAGAGTGACTATGCAATGGCCAATGAGGCTCTCAACAAGCTGGCT
GCACATCTGTCTGCTGTGCATCCCCAACTTTGTGCGAGATCCATTTGCTT
TGGTCCGTGGGATGGAGGGATGGTGACGCCTGCACTCAAGGCCAACTTCA
TCAGAATGGGCATTCAGATTATCCCTCGTCAAGGTGGAGCACAGACAGTT
GCGAACATGCTTGTCAGCTCCAGCCCTGGTCAGCTCCTTGTTGGGAACTG
GGGAGTGCCACCTGTGGTTCCAAGTGCCACTGAGCACACTGTTTTGCAGA
CTCTTCGTCAGAGCGACAACCCCTTCTTGGATTCACATGTCATTCAAGGG
AGAAGGGTTTTGCCGATGACACTGGCTGTCGGCTACATGGCTCACCAAGC
TCAGAGCATCTACGCTGGACATCAGCTTTGGGCAGTTGAGGATGCCCAGC
TTTTCAAAGGCATAGCCATTGACAATGGAGCTGATGTTCCGGTTAGGGTT
GAGTTGTCAAGGAGAAAGGAGGAACAAGAGGATGCTGGCAAGGTCAAGGT
CAAGGTTCAAGTGCTTCTCAAATCTCAAGTCAATGGCAAGTCAGTCCCTG
CTTACAAGGCGACTGTCGTGCTTTCCCCTGCTCCACGTCCCAGTGTCATC
ACCCGTGACTTTGATCTCACTCCTGACCCAGCCTGCACCGAACATGACCT
CTATGATGGCAAGACGCTCTTCCACGGCAAAGCCTTCCAAGGAATAGAAC
AAGTTCTTTCTGCGACGCCAAAACAGCTCACTGCCAAATGCAGAAACCTT
CCACTCACACCGGAGCAGCGTGGCCAGTTTGTGGTCAATCTCAGCCAGCA
AGACCCATTCCAAGCTGACATTGCTTTCCAAGCCATGCTTGTTTGGGCTA
GGATGTTGAGACAGTCTGCTGCGCTGCCCAATAACTGTGAAAGGTTTGAT
TTCTACAAACCGATGGCTCCTGGAGCAACTTACTATACCAGTGTCAAACT
GGCTTCAGCTTCACCATTGGTGGATTCTGTGTGCAAATGCACTGTTGCCA
TGCACGATGAGCAAGGTGAAGTGTACTTCTCTGCGAGAGCCAGTGTTGTC
CTCAACAAGACACTCACATACTGA
```

SEQ ID NO:4 shows the amino acid sequence of an exemplary PFA2 protein:

```
MPCDNIAVVGMAVQYAGCKNQDEFWDTLMRKEINSSPISAERLGTRYRDL
HFHPQRSKYADTFCNDRYGCVDASVDNEHDLLADLARRALLDAGINLDDA
STTANLRDFGIVSGCLSFPMDNLQGELLNLYQVHVENRVGAQRFRDSRPW
SERPRAVSPEASDPRVYSDPASFVANQLGLGPVRYSLDAACASALYCLKL
ASDHLLSRSADVMLCGATCFPDPFFILSGFSTFQAMPLGGPDDNPLSVPL
RQGSQGLTPGEGGAIMVLKRLEDAVRDGDRIYGTLLGTSLSNAGCGLPLS
PHLPSEKSCMEDLYTSVGIDPSEVQYVECHATGTPQGDVVEVEALRHCFR
GNTDHPPRMGSTKGNFGHTLVAAGFAGMAKVLLSMQHGTIPPTPGVDRSN
CIDPLVVDEAIPWPYSSAQARAGKPGDELKCASLSAFGFGGTNAHCVFRE
HRQIAATATASPVLPEVTPGPIAIIGMDATFGTLKGLDAFEQAIYKGTDG
ASDLPSKRWRFLGADTDFLTAMGLDAVPRGCYVRDVDVDYKRLRSPMIPE
DVLRPQQLLAVATMDRALQDAGMATGGKVAVLVGLGTDTELYRHRARVTL
KERLDPAAFSPEQVQEMMDYINDCGTSTSYTSYIGNLVATRVSSQWGFTG
PSFTVTEGANSVYRCLELGKFLLDTHQVDAVVVAGVDLCATAENLYLKAR
RSAISRQDHPRANFEASADGYFAGEGSGALVLKRQADVGSDDKVYASVAG
```

LTCAAQPAEAVSPLLLQVHNDDNEKRVVEMVELAADSGRHAPHLANSPLS

AESQLEQVSKLLAHQVPGSVAIGSVRANVGDVGYASGAASLIKTALCLHN

RYLPANPQWERPVAPVSEALFTCPRSRAWLKNPGESRLAAVASASESGSC

FGVLLTDEYATHESSNRLSLDDAAPKLIAIRGDTVDDIMAKVNAELALLR

AHAETGSATDDDPAAAVAFTAHRLRFLRLVGETVASHGATATLCLALLTT

PEKLEKELELAAKGVPRSAKAGRNWMSPSGSAFAPTPVTSDRVAFMYGEG

RSPYYGVGLDLHRLWPALHERINDKTAALWENGDSWLMPRAVDADSQRAV

QTAFDADQIEMFRTGIFVSICLTDYARDVLGVQPKACFGLSLGEISMLFA

LSRRNCGLSDQLTQRLRTSPVWSTQLAVEFQALRKLWNVPADAPVESFWQ

GYLVRASRAEIEKAIGPDNRFVRLLIVNDSSSALIAGKPAECLRVLERLG

GRLPPMPVKQGMIGHCPEVAPYTPGIAHIHEILEIPDSPVKMYTSVTNAE

LRGGSNSSITEFVQKLYTRIADFPGIVDKVSRDGHDVFVEVGPNNMRSAA

VSDILGKAATPHVSVALDRPSESAWTQTLKSLALLTAHRVPLHNPTLFAD

LYHPTFLTAIDSAMQEPPPKPNRFLRSVEVNGYFCPDGISKQVAAASAKP

STHCMVRLHPAKAVVVAAAGAVVADSTPVVKAQTSSSLLVGDDAFLRCY

DVDWPLYMGAMAEGISSVDLVVAAAEARMLASFGAARLPMDQVELQIREI

QQRTSNAFAVNLMPGPDEAATVDALLRTGVSIVEASGYTGALSADLVRYR

VTGLRRTSCGASVSATHRVVAKVSRTEVAEHFLRPAPAAVLEALVAAKQI

TPEQAALASRVAMADDVAVEADSGGHTDNRPIHVLLPLVVAQRNRWRHLV

DTPVRVGAGGGIACPRAALLAFSLGAAFVVTGSVNQLAREAGTSDAVRLL

LATATYSDVAMAPGGVQVLKKQTMFAARATMLAQLQAKFGSFDAVPEPQL

RKLERSVFKQSVADVWAAAREKFGVDATAASPQERMALCVRWYMSQSSRW

ATEATSARKADYQIWCGPAIGSFNDFVRGTKLDATAGTGEFPRVVDINQH

ILLGASHYRRVQQQQQDDDVEYIIV

SEQ ID NO:5 shows the nucleotide sequence of an exemplary PFA2 gene, referred to herein as PFA2 v1, isolated from Thraustochytrid Schizochytrium sp. (as represented by ATCC Accession No. PTA-9695):

ATGCCGTGCGATAACATTGCGGTCGTGGGCATGGCGGTGCAGTATGCCGG

ATGCAAGAACCAGGACGAGTTCTGGGATACGCTGATGCGTAAGGAGATCA

ACTCGAGCCCGATCTCGGCGGAGCGCCTCGGTACGCGCTACCGCGACCTC

CACTTCCACCCGCAGCGCAGCAAGTACGCCGACACCTTCTGCAACGATCG

CTACGGCTGCGTCGATGCCAGCGTCGACAACGAGCACGACCTCCTCGCCG

ACCTGGCCCGGCGCGCCCTGCTCGACGCCGGAATTAACCTCGACGACGCC

AGCACCACCGCCAACCTACGCGACTTCGGCATCGTGAGCGGCTGCCTGTC

GTTCCCCATGGACAATCTGCAGGGCGAGCTGCTCAATCTGTACCAAGTGC

ATGTGGAGAACCGCGTGGGCGCCCAGCGCTTCCGCGACTCGCGCCCCTGG

TCGGAGCGCCCGCGCGCTGTCTCGCCCGAGGCCAGCGACCCGCGCGTGTA

CTCCGACCCGGCGTCCTTCGTGGCCAACCAGCTCGGCCTGGGGCCCGTGC

GCTACAGCCTCGATGCAGCCTGCGCGTCGGCGCTGTACTGCCTCAAGCTG

GCGTCCGACCACTTGCTCTCGCGCAGCGCGGACGTGATGCTGTGCGGCGC

CACATGCTTTCCGGACCCGTTCTTCATTCTCTCGGGGTTCTCCACCTTCC

AGGCGATGCCGCTGGGCGGACCGGACGATAACCCACTGTCCGTGCCGCTG

CGGCAGGGCAGCCAGGGCCTGACGCCCGGAGAGGGCGGCGCCATCATGGT

GCTGAAGCGCCTCGAGGACGCCGTGCGCGACGGCGACCGCATCTACGGCA

CCTTGCTCGGCACGAGTCTGAGCAACGCCGGGTGCGGCCTGCCGCTGAGC

CCGCACCTGCCGAGCGAGAAGTCGTGCATGGAGGACCTGTACACGAGCGT

CGGCATCGACCCAAGCGAGGTGCAGTACGTGGAGTGCCACGCCACGGGCA

CTCCGCAGGGCGACGTCGTGGAGGTAGAGGCGCTGCGCCACTGCTTTCGA

GGTAACACGGACCACCCGCCGCGCATGGGCTCCACCAAGGGCAACTTTGG

CCACACTCTCGTGGCGGCCGGGTTCGCAGGCATGGCCAAGGTGCTGCTGT

CGATGCAGCACGGCACGATCCCGCCCACGCCCGGTGTCGACCGCTCCAAC

TGCATCGACCCGCTCGTCGTGGACGAGGCCATCCCTTGGCCGTACTCGTC

GGCGCAGGCGCGGGCAGGCAAACCAGGCGATGAGCTCAAGTGCGCCTCGC

TCTCCGCCTTTGGCTTTGGTGGAACCAACGCGCACTGTGTCTTCCGTGAG

CACCGCCAAATTGCTGCTACTGCGACAGCCTCGCCGGTGCTTCCCGAGGT

GACTCCTGGACCGATTGCCATCATCGGGATGGACGCGACGTTTGGTACCC

TCAAGGGCCTGGACGCGTTTGAGCAGGCCATCTACAAGGGCACGGACGGC

GCCAGCGACCTGCCGAGCAAGCGCTGGCGGTTCCTGGGCGCCGACACGGA

CTTCTTGACCGCCATGGGCCTCGACGCCGTGCCGCGCGGGTGCTACGTGC

GCGACGTGGACGTGGACTACAAGCGGCTGCGGTCGCCGATGATCCCTGAG

GACGTCCTGCGCCCGCAACAGCTGCTGGCGGTGGCTACGATGGACCGCGC

GCTGCAGGACGCTGGAATGGCGACGGGAGGCAAGGTGGCGGTGCTGGTGG

GGCTCGGCACGGACACCGAGCTGTACCGGCACCGCGCGCGCGTGACACTC

AAGGAGCGGCTCGACCCGGCCGCGTTCTCGCCCGAGCAGGTGCAGGAGAT

GATGGACTACATCAACGACTGCGGCACCTCGACGTCGTACACGTCGTACA

TCGGCAACCTCGTGGCCACGCGCGTGTCCTCGCAGTGGGGCTTTACGGGC

CCGTCCTTCACCGTCACCGAAGGCGCAAACTCGGTCTACCGCTGCCTCGA

GCTGGGCAAGTTCCTGCTCGACACGCACCAGGTGGACGCCGTCGTGGTGG

CCGGCGTCGACCTCTGTGCCACCGCCGAGAACCTTTACCTCAAGGCGCGC

CGCTCCGCCATCAGCCGACAGGACCACCCTCGCGCCAACTTTGAGGCCAG

CGCCGACGGGTACTTTGCCGGCGAGGGCAGCGGCGCCCTGGTCCTCAAGC

GCCAGGCCGACGTTGGCTCAGACGACAAGGTCTACGCCAGTGTCGCGGGC

CTCACGTGCGCCGCGCAGCCCGCTGAAGCCGTGTCGCCGCTACTACTCCA

AGTCCACAACGACGACAACGAGAAGAGGGTGGTGGAGATGGTGGAGCTCG

CCGCCGACTCGGGTCGCCATGCGCCGCACTTGGCCAACTCGCCGCTGAGC

GCCGAGTCGCAGCTGGAGCAAGTGTCCAAGTTGCTCGCGCACCAGGTGCC

GGGCTCGGTGGCCATCGGCAGCGTGCGCGCCAACGTGGGAGACGTCGGGT

ACGCCTCGGGCGCCGCGAGCCTCATCAAGACGGCGCTGTGCCTCCACAAC

CGCTACCTCCCGGCCAACCCCGCAGTGGGAGCGGCCGGTGGCGCCGGTCTC

CGAGGCGCTGTTTACTTGCCCGCGCTCGCGTGCCTGGCTGAAGAACCCGG

GCGAGTCGCGACTGGCGGCTGTCGCCAGTGCCTCCGAGAGCGGGTCCTGC

-continued

TTTGGCGTGCTCCTCACAGACGAGTACGCCACTCATGAGAGCAGCAACCG

CCTCTCGCTGGATGACGCCGCCCCCAAGCTCATCGCGATCCGTGGCGACA

CCGTTGACGATATCATGGCCAAGGTCAACGCCGAGCTGGCGCTCCTCCGA
GCGCACGCCGAAACCGGGTCTGCTACTGACGACGACCCAGCTGCTGCTGT
CGCTTTCACTGCTCATCGCTTGCGCTTTTTGCGGCTCGTAGGGGAGACGG
TGGCTAGTCACGGTGCCACGGCGACCTTGTGTTTGGCCCTGCTGACAACG
CCGGAGAAGCTGGAGAAGGAGTTGGAGCTGGCAGCCAAGGGTGTACCGCG
AAGCGCCAAGGCCGGGCGCAACTGGATGTCGCCATCGGGCAGCGCCTTTG
CGCCGACACCTGTGACCAGCGACCGCGTCGCGTTCATGTACGGCGAGGGC

CGCAGCCCCTACTACGGCGTCGGGCTCGACCTGCACCGCCTGTGGCCGGC

TTTGCACGAGCGCATCAACGACAAGACCGCGGCGCTGTGGGAGAACGGCG

ACTCGTGGCTCATGCCGCGCGCGGTGGATGCCGACTCGCAGCGCGCCGTG

CAGACGGCCTTTGACGCGGACCAGATCGAGATGTTCCGCACGGGCATCTT
CGTGTCCATCTGCCTCACCGACTACGCGCGCGACGTGCTCGGGGTGCAGC
CCAAGGCGTGCTTCGGCCTCAGCCTCGGCGAGATCTCCATGCTCTTTGCG
CTGTCGCGACGCAACTGCGGCCTGTCGGACCAGCTCACGCAGCGCCTACG
CACCTCGCCGGTGTGGTCGACACAGCTGGCGGTGGAGTTCCAGGCCTTGC
GCAAGCTATGGAACGTGCCGGCGGACGCCCCCGTGGAGTCCTTCTGGCAG
GGCTACTTGGTTCGCGCCAGCCGCGCCGAAATCGAGAAGGCGATCGGGCC
CGACAACCGCTTCGTGCGCCTGCTGATCGTCAACGACTCGAGCAGCGCGC
TGATCGCCGGCAAACCTGCCGAGTGTCTGCGCGTGCTGGAGCGCCTGGGC
GGGCGGTTGCCGCCGATGCCCGTCAAGCAAGGCATGATTGGGCACTGCCC
CGAAGTGGCGCCCTACACGCCGGGCATCGCGCACATCCACGAGATTTTGG
AGATTCCGGACAGCCCCGTCAAGATGTACACCTCGGTCACCAACGCCGAG
CTGCGCGGGGGCAGCAACAGCAGCATCACCGAGTTCGTGCAGAAGTTGTA
CACGCGCATCGCCGACTTTCCGGGCATCGTCGACAAGGTCAGCCGTGACG
GCCACGATGTCTTCGTCGAGGTGGGGCCGAACAACATGCGCTCCGCCGCG
GTCAGTGACATTCTTGGCAAGGCTGCCACCCCGCATGTCTCCGTGGCGCT

GGACCGCCCCAGTGAGTCGGCGTGGACGCAGACCCTCAAGTCGCTGGCGC

TGCTGACCGCCCACCGCGTGCCCCTGCACAACCCGACTCTGTTTGCGGAC

CTGTACCACCCCACGTTCCTGACGGCTATCGACTCTGCGATGCAGGAGCC

CCCGCCCAAGCCCAACCGCTTCCTTCGCAGCGTAGAGGTCAACGGGTACT
TTTGCCCCGACGGCATCAGCAAGCAGGTTGCTGCTGCAAGTGCCAAACCC
TCGACGCATTGCATGGTTCGTTTGCACCCAGCCAAGGCAGTTGTGGTTGC
TGCTGCTGGTGCTGTGGTTGCTGATTCGACGCCCGTGGTCAAGGCCAAGC
AGACGTCGTCGTCGTTGTTGGTTGGGGATGACGCCTTTCTGCGCTGCTAC
GACGTGGACTGGCCGCTCTACATGGGCGCCATGGCGGAAGGCATCTCGTC
GGTAGACCTGGTGGTCGCTGCCGCCGAGGCCCGCATGCTGGCATCATTCG
GAGCGGCCCGCTTGCCTATGGACCAGGTGGAACTCCAGATCCGTGAGATC
CAGCAACGCACCTCCAACGCCTTTGCTGTCAACCTGATGCCGGGTCCTGA

-continued

CGAGGCCGCGACGGTGGACGCGCTGCTGCGCACGGGCGTCTCAATCGTCG
AGGCATCGGGCTACACCGGCGCGCTCTCTGCAGACCTGGTGCGCTACCGT
GTCACGGGTCTGCGACGAACTAGTTGCGGTGCTTCTGTGTCGGCGACTCA
CCGTGTGGTCGCCAAGGTGTCGCGCACCGAGGTGGCCGAGCACTTTCTGC
GCCCGGCGCCGGCCGCCGTACTAGAGGCTTTGGTCGCCGCCAAACAGATT
ACGCCCGAGCAGGCCGCGCTGGCCAGCCGCGTCGCCATGGCCGACGACGT
CGCGGTGGAGGCCGACTCGGGCGGGCACACCGACAACCGACCGATCCACG
TGCTGCTGCCGCTCGTGGTGGCGCAGCGCAACCGCTGGCGCCACCTGGTG
GACACGCCAGTGCGCGTCGGCGCCGGCGGCGGGATCGCCTGTCCGCGCGC
CGCGCTGCTCGCCTTTTCCCTGGGCGCCGCCTTTGTGGTCACCGGGTCCG
TCAACCAACTGGCCCGCGAGGCTGGCACCAGCGACGCGGTCCGACTACTG
CTGGCGACGGCCACCTACTCGGACGTGGCCATGGCGCCGGGCGGCGTCCA
GGTGCTCAAGAAGCAGACCATGTTCGCCGCGCGGGCCACGATGCTCGCCC
AGCTGCAGGCCAAGTTCGGCTCCTTTGACGCCGTGCCGGAGCCGCAGCTG
CGCAAGCTCGAGCGCTCCGTGTTCAAGCAGTCCGTGGCGGACGTGTGGGC
TGCTGCACGCGAAAAGTTTGGTGTCGACGCTACCGCTGCAAGTCCGCAGG
AGAGGATGGCGCTCTGTGTGCGCTGGTACATGTCGCAGTCGTCGCGATGG
GCTACCGAGGCGACGTCCGCGCGCAAGGCGGACTACCAGATCTGGTGCGG
CCCCGCCATCGGCAGCTTCAACGACTTCGTTCGCGGCACCAAGCTGGACG
CGACCGCTGGCACCGGCGAGTTTCCGCGCGTCGTGGACATCAACCAGCAC
ATCCTCCTCGGAGCCTCGCACTACCGCCGCGTGCAGCAACAACAACAGGA
CGACGACGTAGAATACATCATCGTATAA

SEQ ID NO:6 shows the nucleotide sequence of an exemplary plant-optimized PFA2 gene, referred to herein as PFA2 v2:

ATGCCGTGTGACAACATTGCTGTGGTTGGAATGGCAGTTCAGTATGCTGG

ATGCAAGAACCAGGACGAGTTCTGGGACACACTGATGAGGAAGGAGATCA

ACAGCTCACCGATCTCAGCGGAGAGGCTTGGGACAAGATACAGAGACCTC

CACTTCCATCCTCAGAGGAGCAAGTATGCAGACACCTTCTGCAATGACAG

ATATGGTTGTGTTGATGCTTCTGTTGACAATGAGCATGACTTGCTTGCTG

ACCTTGCCAGACGTGCTTTGCTTGATGCTGGGATCAACTTGGATGACGCC

AGCACCACTGCCAACCTTCGTGACTTTGGGATTGTGAGTGGATGCCTCTC

CTTCCCGATGGACAATCTGCAAGGTGAGCTTTTGAATCTCTATCAAGTCC

ACGTTGAGAACCGTGTGGGTGCCCAGAGGTTCAGAGATTCAAGACCCTGG

TCAGAAAGACCAAGAGCTGTGTCCCCTGAAGCCAGTGACCCGAGGGTCTA

CAGCGACCCTGCTTCCTTTGTGGCCAACCAGCTTGGTCTTGGTCCTGTCA

GATACAGCCTTGATGCAGCTTGTGCGAGTGCGCTGTACTGCCTCAAGTTG

GCTTCTGATCACTTGCTCTCCCGTTCTGCAGATGTCATGCTGTGTGGTGC

CACATGCTTCCCAGACCCGTTTTTCATTCTCTCTGGGTTCTCCACATTCC

AAGCGATGCCATTGGGTGGACCAGATGACAACCCACTCTCTGTGCCACTC

CGTCAAGGCAGCCAAGGACTCACACCTGGAGAAGGTGGAGCCATCATGGT

-continued

TCTGAAGCGTTTGGAAGATGCTGTGAGGGATGGTGATAGGATCTATGGCA
CCTTGCTTGGGACAAGTCTCAGCAATGCTGGTTGTGGTTTGCCACTTTCA
CCTCACCTGCCGTCTGAGAAAAGCTGCATGGAGGATTTGTACACGTCAGT
TGGCATAGATCCATCTGAGGTTCAGTATGTCGAGTGTCATGCCACCGGAA
CTCCGCAAGGAGATGTGGTTGAAGTTGAGGCTCTGAGACATTGCTTCAGA
GGCAACACTGACCACCCACCGAGGATGGGTTCCACCAAAGGAAACTTTGG
TCACACCTTGGTTGCAGCTGGGTTTGCTGGAATGGCCAAAGTGTTGCTTT
CCATGCAGCATGGCACGATCCCACCCACGCCTGGTGTTGATAGGAGCAAC
TGCATAGATCCGCTGGTCGTTGATGAGGCCATACCCTGGCCTTACAGCTC
AGCTCAAGCGAGAGCTGGCAAACCTGGAGATGAATTGAAGTGTGCTTCCC
TCTCAGCCTTTGGATTTGGTGGAACAAATGCTCATTGTGTGTTCAGAGAA
CACAGACAGATTGCTGCCACTGCGACAGCGTCTCCGGTCCTTCCTGAAGT
CACCCCTGGACCCATTGCAATCATTGGGATGGATGCGACGTTTGGCACCC
TCAAAGGACTTGATGCGTTTGAACAAGCGATCTACAAAGGCACGGATGGA
GCATCTGATCTGCCATCCAAGAGATGGAGGTTCCTTGGTGCTGACACAGA
TTTCTTGACTGCAATGGGTCTGGATGCAGTCCCGAGAGGGTGCTATGTGA
GGGATGTTGATGTGGACTACAAAAGACTCAGAAGTCCCATGATCCCTGAA
GATGTCCTCAGACCCCAACAGCTTCTGGCAGTTGCCACGATGGATAGGGC
ACTTCAAGATGCTGGCATGGCCACGGGTGGAAAAGTTGCTGTCCTGGTGG
GGTTGGGCACTGACACTGAGCTTTACAGACACCGTGCAAGGGTGACACTC
AAGGAAAGGCTTGACCCAGCAGCTTTCTCCCCTGAACAAGTTCAAGAAAT
GATGGATTACATCAATGATTGTGGAACCTCAACCAGCTACACTTCTTACA
TTGGGAATCTTGTGGCCACCAGAGTTTCCTCACAGTGGGGATTCACTGGT
CCTTCTTTCACGGTCACTGAAGGTGCAAACTCAGTCTATCGTTGCCTTGA
GCTGGGAAAGTTCCTTTTGGACACCCACCAAGTGGATGCAGTTGTGGTTG
CTGGAGTTGATCTCTGTGCAACTGCTGAGAACCTTTACCTCAAGGCAAGA
AGGTCTGCCATAAGCAGACAAGACCATCCACGTGCCAACTTTGAGGCTTC
TGCTGATGGATACTTTGCTGGAGAGGGCAGTGGTGCTCTGGTCTTGAAGA
GGCAAGCTGATGTTGGCTCAGATGACAAGGTCTATGCCAGTGTTGCTGGC
CTCACATGTGCAGCGCAGCCTGCTGAAGCAGTTTCTCCTCTTCTCCTTCA
AGTTCACAATGATGACAATGAGAAAGGGTTGTGGAGATGGTGGAACTCG
CAGCTGACTCTGGTCGTCATGCTCCCCACTTGGCCAACTCTCCTTTGAGT
GCTGAATCACAGCTTGAGCAAGTGTCTAAACTCTTGGCTCATCAAGTCCC
TGGTTCAGTCGCGATTGGAAGTGTTCGTGCCAATGTTGGAGATGTTGGAT
ATGCGAGTGGTGCAGCTTCTCTCATAAAGACTGCGCTTTGCCTCCACAAC
CGTTACTTGCCTGCAAACCCACAGTGGGAAAGACCTGTGGCTCCAGTCTC
AGAGGCTCTTTTCACCTGTCCAAGGTCCCGTGCTTGGCTCAAGAACCCTG
GTGAGTCCAGACTTGCTGCAGTGGCCAGTGCTTCTGAGAGTGGGTCTTGC
TTTGGAGTGCTTCTCACAGATGAGTATGCCACACATGAGTCCAGCAACAG
ATTGTCATTGGATGACGCTGCACCCAAACTCATAGCGATTCGTGGAGACA

-continued

CTGTTGATGACATCATGGCAAAGTCAATGCTGAACTTGCGTTGCTCCGT
GCTCATGCAGAAACTGGGTCTGCCACTGACGATGACCCAGCTGCAGCTGT
TGCTTTCACTGCTCATCGTTTGAGGTTCTTGAGGCTTGTTGGTGAAACAG
TTGCCAGTCACGGTGCCACAGCGACCTTGTGTTTGGCTCTGCTCACAACT
CCAGAAAAGCTGGAGAAAGAATTGGAGTTGGCAGCCAAGGGTGTTCCAAG
ATCAGCCAAGGCTGGCAGAAACTGGATGTCACCATCTGGTTCTGCTTTTG
CACCAACACCTGTCACCAGTGATCGTGTTGCGTTCATGTATGGTGAAGGG
AGGTCTCCCTACTATGGTGTTGGGTTGGACCTTCACAGACTCTGGCCTGC
TTTGCATGAGAGGATCAATGACAAGACAGCTGCACTTTGGGAGAATGGAG
ACTCCTGGCTCATGCCCAGAGCGGTTGATGCTGACTCTCAGAGGGCTGTC
CAGACGGCTTTTGATGCTGACCAGATAGAGATGTTTAGGACGGGAATCTT
TGTTTCCATTTGCCTCACAGACTATGCTCGTGATGTCCTTGGAGTCCAAC
CCAAGGCTTGCTTTGGACTCTCCCTTGGAGAAATCTCCATGCTCTTTGCA
CTTTCAAGGAGAAACTGTGGACTTTCTGACCAGCTCACTCAGAGGCTCAG
AACCTCTCCGGTCTGGAGCACACAGCTTGCTGTGGAGTTCCAAGCCTTGA
GGAAACTTTGGAATGTCCCTGCTGATGCTCCAGTTGAGTCCTTCTGGCAA
GGCTACTTGGTTCGTGCCAGCAGAGCAGAGATTGAAAAGGCCATTGGACC
GGACAACAGATTTGTTCGTTTGCTCATTGTCAACGACTCCAGCAGTGCCC
TCATTGCTGGCAAACCTGCTGAGTGTCTGAGGGTGCTTGAGCGTCTTGGA
GGTCGTTTGCCACCCATGCCAGTCAAGCAAGGCATGATTGGGCACTGCCC
AGAAGTGGCTCCCTATACTCCTGGAATAGCTCACATCCACGAAATCTTGG
AGATTCCTGACAGCCCTGTCAAGATGTATACCTCAGTCACCAATGCTGAG
CTGAGAGGAGGCAGCAACTCTTCCATCACAGAGTTCGTTCAGAAGTTGTA
CACCAGAATAGCGGATTTCCCTGGCATTGTTGACAAGGTCAGCCGTGATG
GCCATGATGTTTTCGTGGAAGTTGGTCCGAATAACATGAGGTCAGCAGCT
GTCAGTGACATTCTTGGGAAGGCTGCAACTCCTCATGTCAGTGTGGCTCT
TGATCGTCCAAGTGAGTCAGCTTGGACACAGACACTCAAATCTCTTGCCC
TGCTCACTGCCCACAGAGTGCCTCTTCACAACCCGACTCTCTTTGCGGAT
CTTTACCACCCAACCTTCCTCACAGCCATAGATTCTGCAATGCAAGAACC
ACCTCCCAAGCCCAACAGATTCCTGAGGTCTGTTGAAGTCAATGGTTACT
TCTGCCCTGATGGCATAAGCAAACAAGTTGCAGCTGCAAGTGCCAAACCC
AGCACACATTGCATGGTTCGTCTCCATCCAGCCAAAGCTGTTGTGGTTGC
AGCTGCCGGAGCTGTGGTTGCTGATTCAACACCGGTTGTCAAAGCCAAGC
AGACTTCCTCATCTTTGCTTGTTGGAGACGATGCCTTCCTCAGATGCTAT
GATGTGGATTGCCTCTCTACATGGGAGCGATGGCTGAAGGAATCTCCTC
TGTTGACCTTGTGGTTGCAGCTGCAGAAGCTAGGATGCTTGCATCATTTG
GAGCAGCGAGGCTTCCGATGGATCAAGTTGAACTCCAGATCCGTGAGATC
CAACAGAGAACCTCCAATGCCTTTGCTGTCAACCTCATGCCTGGTCCTGA
TGAAGCTGCAACGGTGGATGCCCTTCTGAGAACGGGAGTCAGCATTGTGG
AGGCGTCTGGTTACACGGGTGCGCTCTCTGCGGATCTGGTGAGATACCGT
GTGACCGGTCTCAGAAGGACCTCCTGTGGTGCTTCTGTGTCAGCGACTCA

-continued

```
CCGTGTTGTGGCCAAAGTTTCAAGAACTGAGGTGGCTGAACATTTCCTGA
GACCAGCACCTGCAGCTGTTCTTGAGGCTTTGGTGGCAGCCAAACAAATC
ACTCCTGAGCAAGCTGCGCTTGCCAGCAGAGTCGCGATGGCTGACGATGT
CGCGGTGGAGGCAGATTCTGGAGGGCACACTGACAACCGTCCAATCCATG
TGCTCCTTCCTTTGGTTGTGGCTCAGAGGAACAGATGGAGGCATCTGGTT
GACACGCCAGTGCGTGTGGGAGCTGGAGGTGGGATAGCATGTCCGAGAGC
AGCGTTGCTTGCCTTCTCCTTGGGTGCAGCCTTTGTGGTCACTGGAAGTG
TCAACCAGCTTGCTCGTGAAGCTGGGACCTCTGATGCAGTCAGACTCCTT
TTGGCGACTGCCACCTATAGTGATGTGGCGATGGCTCCTGGTGGAGTCCA
AGTGTTGAAGAAACAAACCATGTTCGCTGCGAGAGCAACGATGTTGGCTC
AGCTCCAAGCCAAGTTTGGTTCCTTTGATGCTGTGCCAGAACCGCAACTG
AGAAAACTGGAGAGATCAGTGTTCAAGCAGAGTGTTGCTGATGTTTGGGC
AGCTGCAAGGGAAAAGTTTGGGGTTGATGCCACGGCTGCAAGTCCGCAAG
AGAGGATGGCTCTCTGTGTCAGATGGTACATGTCTCAAAGCTCACGTTGG
GCAACAGAGGCCACTTCAGCAAGGAAAGCGGACTATCAGATTTGGTGTGG
TCCTGCAATAGGCAGCTTCAATGACTTCGTCAGAGGCACCAAACTTGATG
CCACGGCTGGGACTGGTGAGTTCCCGAGAGTTGTGGACATCAACCAGCAC
ATCTTGCTGGGAGCCTCTCATTACAGAAGGGTTCAACAGCAACAGCAAGA
CGATGACGTTGAGTACATCATTGTTTGA
```

SEQ ID NO:7 shows the amino acid sequence of an exemplary PFA3 protein:

```
MTSSKKTPVWEMSKEELLDGKTVVFDYNELLEFAEGDVGQVFGPEFDIID
KYRRRVRLPAREYLLVSRVTLMDAEVNNFRVGSRMVTEYDVPVNGELSEG
GDVPWAVLVESGQCDLMLISYMGIDFQCKGDRVYRLLNTSLTFFGVAHEG
ETLVYDIRVTGFAKGAGGEISMFFFEYDCFVDGRLLIEMRDGCAGFFTDA
ELAAGKGVLKTKAELAARAQIQKQDIAPFAPAPCSHKTSLDAREMRLLVD
RQWARVFGSGMAGIDYKLCARKMLMIDRVTHLDPRGGAHGLGLLIGEKVL
ERDHWYFPCHFVRDEVMAGSLVSDGCSQLLKVYMLWLGLHTTVGAFDFRP
VSGHANKVRCRGQISPHKGKLVYVMEIKEMGFDAKTGDPFAIADVDIIDV
NFEEGQAFAGVEDLHSYGQGDLRKKIVVDFKGIALSLQKRKEQQKESMTV
TTTTTTTSRVIAPPSGCLKGDPTAPTSVTWHPMAEGNGGPGPTPSFSPSA
YPPRAVCFSPFPNNPLDNDHTPGQMPLTWFNMSEFMCGKVSNCLGPEFAR
FDASKTSRSPAFDLALVTRVTSVADMEHGPFYNVDVNPGQGTMVGEFDCP
ADAWFFGASSRDDHMPYSILMEIALQTSGVLTSVLKAPLTMDKDDILFRN
LDADAELVGDAMPDVRGKTIRNFTKCTGYSMLGKMGIHRFTFELSVDGAV
FYKGSTSFGWFVPEVFESQTGLDNGKPRLPWYRENNVAVDTLSAPASASS
AQGQLQLQRRGSQAQFLDTIHLAGSGAGVHGQGYAHGEKAVNKQDWFFSC
HFWFDPVMPGSLGIESMFQLVEAWCVKQGLAARHGIAHPVFAHAPGATSW
KYRGQLTPKNDRMDSEVHIKSVAAFSSWVDVVADGFLFVDGLRVYSADNL
RVRIQTGAGHVEEQEVAAKATTKNSSIADVDVADLQALKQALLTLERPLQ
LDAGSEVPACAVSDLGDRGFMETYGVVAPLYSGAMAKGIASADLVIAMGQ
RKMLGSFGAGGLPMHVVRAGIEKIQAALPAGPYAVNLIHSPFDANLEKGN
VDLFLEKGVRVVEASAFMELTPQVVRYRATGLSRDARGGSVRTAHKIIGK
VSRTELAEMFIRPAPQAILDKLVASGEITPEQAALALEVPMADDIAVEAD
SGGHTDNRPIHVILPLILSLRNRLQRELKYPARHRVRVGAGGGIGCPQAA
LGAFHMGAAFVVTGTVNQLSRQAGTCDNVRRQLSRATYSDITMAPAADMF
EQGVELQVLKKGTMFPSRAKKLFELFHKYDSFEAMPADELARVEKRIFSK
SLAEVWAETKDFYITRLNNPEKIRKAENEDPKLKMSLCFRWYLGLSSFWA
NNGIADRTMDYQIWCGPAIGAFNDFIADSYLDVAVSGEFPDVVQINLQIL
SGAAYLQRLLSVKLAPRIDVDTEDDLFTYRPDHAL
```

SEQ ID NO:8 shows the nucleotide sequence of an exemplary PFA3 gene, referred to herein as PFA3 v1, isolated from Thraustochytrid *Schizochytrium* sp. (as represented by ATCC Accession No. PTA-9695):

```
ATGACATCATCGAAGAAGACTCCCGTGTGGGAGATGAGCAAGGAGGAGCT
GCTGGACGGCAAGACGGTGGTCTTCGACTACAACGAGCTGCTCGAATTCG
CCGAGGGCGACGTGGGCCAAGTGTTCGGACCCGAGTTCGACATCATCGAC
AAGTACCGGCGTCGCGTGCGCTGCCGGCGCGCGAGTACCTGCTCGTGTC
GCGCGTGACGCTGATGGACGCCGAGGTGAACAACTTCCGCGTCGGGTCGC
GCATGGTGACCGAGTACGACGTGCCCGTGAACGGGGAGCTGTCGGAGGGC
GGGGACGTGCCCGTGGGCGGTGCTGGTGGAGTCGGGGCAGTGCGACCTGAT
GCTCATCTCGTACATGGGCATCGACTTCCAGTGCAAGGGCGACCGCGTGT
ACCGCCTGCTCAACACATCGCTCACCTTCTTCGGGGTGGCGCACGAGGGC
GAGACGCTGGTGTACGACATCCGCGTCACGGGGTTCGCCAAGGGCGCGGG
CGGGGAGATCTCGATGTTCTTCTTCGAGTACGACTGCTTCGTGGACGGCC
GCCTGCTGATCGAGATGCGCGACGGGTGCGCCGGGTTCTTCACGGACGCC
GAGCTGGCCGCCGGCAAGGGCGTGCTTAAGACCAAGGCGGAGCTGGCCGC
GCGCGCGCAGATCCAGAAGCAGGACATCGCGCCCTTTGCGCCGGCGCCGT
GCTCGCACAAGACCTCGCTGGACGCGCGCGAGATGCGGCTGCTCGTGGAC
CGCCAGTGGGCGCGCGTCTTCGGCAGCGGCATGGCGGGCATCGACTACAA
GTTGTGCGCTCGCAAGATGCTCATGATCGACCGCGTCACGCACCTCGACC
CGCGCGGCGGCGCACGGCCTCGGGCTGCTGATCGGGGAGAAGGTGCTG
GAGCGCGACCACTGGTACTTCCCCTGCCACTTTGTGCGCGACGAGGTGAT
GGCCGGGTCGCTGGTCAGCGACGGCTGCTCGCAGCTCCTCAAGGTGTACA
TGCTGTGGCTCGGCCTGCACACGACCGTGGGCGCGTTCGACTTTCGTCCC
GTGAGCGGGCACGCCAACAAGGTGCGGTGCCGCGGGCAGATCTCACCGCA
CAAGGGCAAGCTCGTGTACGTGATGGAGATCAAGGAAATGGGCTTTGACG
CGAAGACGGGCGATCCGTTTGCGATCGCGGACGTGGACATCATCGACGTC
AACTTCGAGGAGGGACAGGCGTTTGCGGGAGTGGAAGACCTGCACAGCTA
CGGCCAGGGCGACCTCCGCAAGAAGATCGTCGTCGACTTCAAGGGCATCG
CGCTCTCCCTGCAGAAGCGGAAGGAGCAGCAGAAGGAAAGCATGACCGTG
```

```
ACTACGACGACGACGACGACGAGCCGGGTGATTGCGCCGCCCAGCGGGTG
CCTCAAGGGCGACCCGACGGCGCCGACGAGCGTGACGTGGCACCCGATGG
CGGAGGGCAACGGCGGGCCCGGACCGACGCCGTCGTTCTCGCCGTCCGCG
TACCCGCCGCGGGCGGTGTGCTTCTCGCCGTTCCCCAACAACCCGCTTGA
CAACGACCACACGCCGGGCCAGATGCCGTTGACCTGGTTCAACATGTCCG
AATTCATGTGCGGCAAAGTGTCCAACTGCCTGGGCCCCGAGTTTGCGCGC
TTCGACGCGAGCAAGACGAGCCGCAGCCCGGCCTTTGACCTGGCGCTCGT
GACGCGGGTGACGAGCGTGGCGGACATGGAGCACGGGCCGTTCTACAACG
TGGACGTCAACCCGGGCCAGGGCACGATGGTGGGCGAGTTCGACTGTCCC
GCGGACGCGTGGTTCTTCGGCGCCTCGAGCCGCGACGACCACATGCCGTA
CTCGATCCTGATGGAGATCGCGCTGCAGACGTCGGGCGTCCTCACCTCGG
TGCTCAAGGCGCCGCTGACGATGGACAAGGACGACATCCTCTTCCGCAAC
CTCGACGCAGACGCCGAGCTCGTGGGCGACGCCATGCCGGACGTGCGCGG
CAAGACGATCCGCAACTTCACCAAGTGCACAGGCTACAGCATGCTCGGCA
AGATGGGCATCCACCGCTTCACCTTTGAGCTCAGCGTCGACGGCGCCGTC
TTCTACAAGGGCAGCACCTCGTTTGGCTGGTTCGTCCCCGAGGTCTTCGA
GTCGCAGACCGGTCTCGACAACGGCAAGCCGCGCCTGCCTTGGTACCGCG
AGAACAACGTCGCCGTCGACACGCTCTCCGCGCCCGCCTCCGCTTCCTCC
GCGCAAGGTCAGCTGCAGCTGCAGCGACGCGGGTCGCAGGCGCAGTTCCT
GGACACAATCCACCTGGCGGGCAGCGGCGCCGGCGTGCACGGCCAGGGCT
ACGCGCACGGGGAGAAGGCCGTGAACAAGCAAGATTGGTTCTTCTCGTGC
CACTTCTGGTTCGACCCCGTGATGCCCGGGTCCCTGGGCATCGAGTCGAT
GTTCCAGCTCGTCGAGGCGTGGTGCGTGAAGCAGGGACTCGCGGCGCGGC
ACGGCATCGCTCACCCAGTGTTCGCGCACGCGCCCGGGGCCACGAGCTGG
AAGTACCGCGGGCAGCTAACCCCCAAGAACGACCGCATGGACAGCGAGGT
GCACATCAAGTCGGTGGCGGCCTTCTCCTCCTGGGTCGACGTCGTCGCGG
ACGGGTTCCTCTTCGTCGACGGCCTCCGCGTCTACTCGGCAGACAACCTC
CGCGTCCGCATCCAGACCGGCGCCGGCCACGTTGAAGAGCAAGAGGTTGC
TGCCAAGGCCACAACCAAGAACAGCAGTATTGCTGATGTGGACGTGGCGG
ACCTGCAAGCGCTCAAGCAGGCGTTGCTGACGCTGGAGCGACCGCTGCAG
CTGGACGCGGGGAGCGAGGTGCCCGCCTGCGCGGTGAGCGACCTGGGCGA
TAGGGGCTTCATGGAGACGTACGGGGTGGTGGCGCCGCTGTACAGCGGGG
CGATGGCCAAGGGCATCGCGTCGGCGGACCTGGTGATCGCGATGGGCCAG
CGCAAGATGCTGGGGTCGTTTGGCGCGGGCGGGCTCCCGATGCACGTCGT
GCGCGCGGGGATTGAGAAGATCCAGGCAGCGCTGCCAGCGGGGCCATACG
CGGTCAACCTGATTCACTCGCCTTTTGACGCCAACCTGGAGAAGGGCAAC
GTGGACCTCTTCCTGGAGAAGGGCGTGCGCGTCGTGGAGGCGTCGGCCTT
CATGGAGCTCACGCCCCAGGTGGTGCGCTACCGCGCGACGGGCCTCTCTC
GCGACGCGCGCGGCGGCTCCGTGCGCACGGCCCACAAGATCATCGGCAAG
GTCAGCCGCACCGAGCTGGCCGAGATGTTTATCCGGCCCGCGCCGCAAGC
```

```
CATTCTCGACAAGCTTGTGGCGTCCGGCGAGATCACCCCCGAGCAGGCGG
CGCTGGCGCTCGAGGTGCCCATGGCGGACGACATCGCCGTCGAGGCCGAT
TCGGGCGGGCACACCGACAACCGCCCCATCCACGTCATCCTGCCCCTCAT
CCTCAGCCTGCGCAACCGCCTCCAGCGCGAGCTCAAGTACCCTGCGCGAC
ACCGCGTGCGCGTCGGCGCCGGGGGCGGCATCGGGTGCCCGCAAGCGGCT
CTGGGCGCCTTCCACATGGGCGCCGCGTTTGTGGTGACGGGCACGGTCAA
CCAGCTGAGCCGGCAGGCCGGGACATGCGACAATGTGCGGCGGCAGCTGT
CGCGCGCGACGTACTCGGACATCACGATGGCGCCGGCGGCGGACATGTTC
GAGCAGGGCGTCGAGCTGCAGGTGCTCAAGAAGGGCACGATGTTTCCCTC
GCGCGCCAAGAAGCTGTTCGAGCTGTTTCACAAGTACGACTCGTTCGAGG
CGATGCCGGCGGACGAGCTGGCGCGCGTCGAGAAGCGCATCTTCAGCAAG
TCACTCGCCGAGGTGTGGGCCGAGACCAAGGACTTCTACATCACGCGGCT
CAACAACCCGGAGAAGATCCGCAAGGCGGAGAACGAGGACCCCAAGCTCA
AGATGTCACTCTGCTTCCGCTGGTACCTCGGGCTCAGCTCGTTCTGGGCC
AACAACGGCATCGCGGACCGCACGATGGACTACCAGATCGGTGCGGCCC
TGCCATCGGCGCCTTCAACGACTTCATCGCCGACTCGTACCTCGACGTGG
CCGTCTCGGGCGAGTTCCCCGACGTCGTGCAGATCAACCTGCAGATCCTG
TCGGGCGCAGCCTACCTCCAGCGCCTCCTCTCCGTCAAGCTCGCACCGCG
GATCGACGTCGACACCGAGGACGACCTCTTCACCTACCGCCCCGACCACG
CACTCTAA
```

SEQ ID NO:9 shows the nucleotide sequence of an exemplary plant-optimized PFA3 gene, referred to herein as PFA3 v2:

```
ATGACATCTTCAAAGAAAACTCCTGTTTGGGAAATGAGCAAGGAAGAGCT
GTTGGATGGCAAGACGGTTGTCTTTGACTACAACGAGCTGTTGGAGTTTG
CGGAGGGTGATGTTGGTCAAGTGTTTGGACCAGAGTTTGACATCATTGAC
AAGTACAGAAGGCGTGTGAGGCTTCCAGCCAGAGAATACTTGCTTGTTTC
AAGAGTGACTCTCATGGATGCCGAGGTGAATAACTTCAGAGTTGGCTCCA
GAATGGTCACTGAGTATGATGTTCCAGTCAATGGTGAGTTGTCAGAGGGA
GGTGATGTTCCCTGGGCAGTTCTTGTTGAAAGTGGGCAGTGTGACTTGAT
GCTCATCTCCTACATGGGGATTGACTTCCAGTGCAAAGGGGACCGTGTTT
ACAGATTGCTCAACACATCTCTCACCTTCTTTGGGGTTGCCCATGAAGGA
GAAACCCTTGTGTATGACATCAGAGTCACTGGTTTCGCCAAGGGTGCTGG
TGGGGAAATCTCAATGTTCTTTTTCGAGTATGACTGCTTTGTTGATGGCA
GATTGCTCATAGAGATGAGAGATGGTTGTGCTGGCTTCTTTACTGATGCC
GAACTTGCCGCTGGAAAAGGTGTGCTCAAAACGAAGGCTGAGCTTGCTGC
ACGTGCTCAGATCCAGAAACAAGACATTGCACCCTTTGCACCTGCACCGT
GCAGTCACAAAACCAGCTTGGATGCCAGAGAAATGAGACTGCTTGTTGAT
AGGCAATGGGCAAGGGTCTTTGGTTCTGGAATGGCTGGCATAGACTACAA
GTTGTGTGCGAGAAAGATGCTGATGATTGACAGAGTCACACACCTTGATC
CGCGTGGAGGTGCTCACGGTCTTGGGCTTCTCATTGGGGAGAAAGTGCTT
```

-continued

```
GAGAGGGACCACTGGTACTTCCCCTGCCACTTTGTGAGGGATGAGGTCAT
GGCTGGTTCTCTTGTCTCAGATGGATGCTCTCAGCTTCTCAAGGTTTACA
TGTTGTGGCTTGGCCTTCACACCACTGTTGGTGCGTTCGACTTTCGTCCA
GTCAGTGGTCATGCCAACAAAGTGAGGTGTCGTGGACAGATTTCACCGCA
CAAGGGGAAACTTGTTTATGTCATGGAGATCAAAGAAATGGGCTTTGATG
CCAAAACTGGAGATCCATTTGCCATAGCTGATGTTGACATCATTGATGTC
AACTTTGAAGAGGGACAAGCGTTTGCTGGAGTTGAGGATCTTCACAGCTA
TGGCCAAGGAGATTTGAGGAAAAAGATAGTTGTGGATTTCAAGGGAATTG
CGTTGTCACTGCAGAAAAGGAAGGAGCAACAGAAAGAGAGCATGACTGTC
ACCACTACGACCACGACAACCAGCAGAGTGATTGCTCCTCCAAGTGGATG
CCTCAAAGGTGATCCCACTGCTCCCACCTCTGTCACGTGGCATCCAATGG
CTGAGGGAAATGGAGGTCCTGGACCCACTCCGTCCTTCTCTCCTTCAGCG
TATCCTCCCAGAGCTGTTTGCTTCTCTCCTTTCCCCAACAATCCGCTTGA
CAATGATCATACACCTGGCCAAATGCCGTTGACCTGGTTCAACATGTCTG
AGTTCATGTGTGGAAAAGTGAGCAACTGCTTGGGTCCTGAGTTTGCCAGA
TTTGATGCTTCCAAGACATCCAGATCACCAGCTTTTGACCTGGCTCTTGT
GACAAGGGTGACGAGTGTGGCTGACATGGAACATGGTCCTTTCTACAATG
TGGATGTCAACCCTGGCCAAGGCACGATGGTGGGTGAGTTTGATTGTCCT
GCAGATGCTTGGTTCTTTGGAGCCTCAAGCAGAGACGATCACATGCCGTA
CAGCATCTTGATGGAGATTGCTCTTCAGACTTCTGGAGTCCTCACATCTG
TGCTCAAAGCTCCGCTCACAATGGACAAAGATGACATCCTTTTCAGAAAC
CTTGATGCAGATGCAGAACTTGTGGGTGATGCCATGCCTGATGTCAGAGG
GAAAACCATAAGGAACTTCACCAAATGCACGGGATACTCCATGCTTGGCA
AGATGGGAATCCATCGTTTCACCTTCGAACTCTCTGTTGACGGAGCAGTT
TTCTACAAAGGGAGCACCTCTTTTGGTTGGTTTGTTCCTGAGGTCTTTGA
GAGCCAGACTGGATTGGACAATGGCAAGCCGAGGTTGCCTTGGTATAGGG
AAAACAATGTGGCAGTGGACACACTCTCAGCACCTGCGTCAGCTTCTAGT
GCCCAAGGTCAGCTTCAGCTTCAGAGGAGAGGGTCACAAGCGCAGTTCCT
GGACACAATTCATCTTGCTGGGAGTGGAGCTGGAGTGCATGGCCAAGGTT
ATGCTCATGGGAGAAAGCTGTGAACAAGCAAGATTGGTTCTTTTCTTGC
CATTTCTGGTTTGACCCAGTGATGCCTGGGTCTTTGGGAATTGAGTCCAT
GTTCCAGCTTGTGGAAGCGTGGTGTGTCAAACAAGGCTTGGCTGCAAGGC
ATGGAATTGCTCATCCAGTCTTTGCACATGCACCTGGTGCCACCAGCTGG
AAGTACAGAGGTCAGTTGACCCCAAAGAATGACAGAATGGACAGTGAAGT
TCACATCAAGAGTGTTGCTGCCTTCTCCTCATGGGTTGATGTGGTTGCTG
ATGGGTTCCTCTTCGTTGATGGCCTCAGAGTCTATTCAGCAGACAACCTG
AGGGTCAGAATCCAGACTGGAGCTGGCCATGTTGAAGAGCAAGAAGTTGC
TGCCAAAGCCACCACAAAGAACTCCAGCATTGCTGATGTGGATGTGGCTG
ATCTTCAAGCTCTCAAACAAGCGTTGCTGACACTGGAGAGACCATTGCAG
TTGGATGCTGGAAGTGAGGTGCCAGCCTGTGCTGTCAGCGATTTGGGAGA
CCGTGGGATTCATGGAGACTTATGGGGTGGTTGCTCCGTTGTACAGTGGTG
CGATGGCCAAGGGAATAGCCTCTGCGGATCTGGTCATAGCAATGGGTCAG
AGGAAGATGTTGGGGAGCTTTGGAGCTGGTGGGTTGCCAATGCACGTTGT
CCGTGCTGGGATTGAAAAGATCCAAGCTGCACTTCCCGCTGGTCCGTATG
CTGTCAACCTCATCCACTCACCGTTCGATGCCAACCTGGAAAAGGGCAAT
GTTGATCTTTTCCTGGAAAAGGGAGTTCGTGTGGTTGAGGCGTCTGCCTT
CATGGAACTCACACCACAAGTGGTCCGTTACAGAGCCACGGGACTCTCCA
GAGATGCGAGAGGTGGCTCAGTGAGGACAGCACACAAGATCATAGGAAAG
GTTTCCAGAACAGAGCTTGCGGAGATGTTCATCAGACCTGCACCTCAAGC
AATTCTGGACAAACTTGTTGCGTCTGGTGAAATCACCCCTGAGCAAGCTG
CGTTGGCTCTTGAAGTTCCAATGGCTGATGACATTGCAGTTGAGGCTGAC
AGTGGAGGGCACACTGACAACCGTCCCATTCATGTCATTCTGCCGTTGAT
CCTCAGTCTGAGGAATAGGCTCCAGAGGGAACTCAAGTACCCTGCCAGAC
ACCGTGTTAGGGTTGGTGCTGGTGGAGGCATAGGTTGTCCTCAAGCTGCA
CTTGGAGCCTTCCACATGGGAGCTGCGTTTGTTGTGACTGGCACTGTCAA
CCAGCTGTCCCGTCAAGCTGGAACATGTGACAACGTGAGGCGTCAGCTCT
CTCGTGCCACTTACTCTGACATCACGATGGCACCAGCTGCAGACATGTTT
GAACAAGGAGTTGAACTGCAAGTTCTCAAGAAAGGAACGATGTTCCCATC
TCGTGCCAAGAAACTCTTTGAACTGTTCCACAAGTATGATTCCTTTGAAG
CAATGCCTGCGGATGAATTGGCTCGTGTTGAGAAGAGGATCTTCTCCAAG
TCCCTTGCAGAAGTTTGGGCAGAGACCAAAGATTTCTACATCACTCGTCT
CAACAATCCTGAAAAGATCAGAAAGGCTGAGAATGAGGACCCCAAGCTCA
AGATGTCCCTCTGCTTCCGTTGGTACTTGGGTCTCAGCTCATTCTGGGCA
AACAATGGCATAGCTGACCGTACGATGGATTACCAGATTTGGTGTGGACC
TGCCATAGGAGCCTTCAACGATTTCATTGCAGACAGCTATCTTGATGTTG
CAGTCTCTGGTGAGTTCCCTGATGTTGTGCAGATCAACCTTCAAATCCTG
TCTGGTGCTGCGTATCTCCAGAGATTGCTCAGTGTCAAACTTGCACCAAG
GATAGATGTGGACACTGAAGATGACCTCTTCACCTACAGACCAGATCATG
CACTCTGA
```

SEQ ID NO:10 shows the nucleotide sequence of an exemplary HetI gene:

```
ATGCTTCAGCACACTTGGCTTCCGAAGCCTCCCAATCTGACCCTCTTGTC
AGATGAGGTTCATCTCTGGAGGATTCCTCTTGACCAGCCTGAGTCACAAC
TTCAAGACCTTGCTGCCACCCTGAGCAGTGATGAATTGGCGAGGGCAAAC
AGATTCTACTTTCCAGAACACAGAAGGCGTTTCACTGCTGGGAGAGGCAT
CCTCAGATCCATCTTGGGTGGATACTTGGGAGTGGAACCGGGTCAAGTCA
AGTTTGATTATGAGTCCCGTGGGAAACCGATCCTTGGTGACAGATTTGCT
GAGAGTGGACTCCTGTTCAACTTGTCTCACAGCCAGAACCTTGCCTTGTG
TGCTGTCAACTACACGCGTCAAATAGGCATTGATCTTGAATATCTGCGTC
CAACATCTGACTTGGAGTCTCTTGCAAAGAGGTTCTTTCTCCCAAGAGAA
```

```
TATGAACTCTTGAGGTCACTCCCTGATGAGCAGAAACAGAAGATTTTCTT

TCGTTACTGGACTTGCAAAGAGGCTTATCTCAAAGCAACGGGAGATGGAA

TAGCCAAACTTGAAGAGATCGAGATAGCACTCACCCCAACAGAACCTGCC

AAGCTCCAAACAGCTCCTGCGTGGTCTCTGTTGGAGCTTGTGCCAGATGA

CAATTGTGTTGCAGCTGTGGCTGTTGCGGGTTTTGGTTGGCAGCCCAAGT

TCTGGCATTACTGA
```

SEQ ID NO:11 shows the nucleotide sequence of an exemplary SzACS2 gene, isolated from *Schizochytrium* ATCC Accession No. 20888:

```
ATGGCTCCCACTCCCGACGCCACCGCGCCTCTGAACAAGCCGAGCGACTA

TGCCGTCTACCACGAGGAAGACGGCCCCTTCTGGACCGCCGATTCCAGCG

GCGTCTCGCGCGTGAACTTTAGCGAGACCGGCGTGGGATCCGAGGGCGTC

ATCCCTGCGCTCACGCTCATCGACGTCTTCGAGAGGGCCGTCAAGCGCGG

CGGAAACAGGATCGCCTTCCGCACGGAAAACATGCCCACGCTCCGCCGCG

GCGAAGAGGCCCCGGACGCGCTGCCGCTCAAGGACTGGAAGTCCTGGTCC

TGGAAACAGTACAAGGCCGACGTCCACCGCATCGCCAGGGCTCTCATGGA

CCTCGGCGTTGAGCAGCATGACGCCGTCTCCATTTTTGGCTTTAACTCGC

CCGAATGGTTTCTCAGTGCCGTCGGCGCCGTGCACGCAGGTGCCAAGATT

GCCGGCATTTACCCCTCAGACACGCCCGCCCAGGTCCAGTACAAGGCCTT

CCACAGTGACACCGCTGTTGCCGTTGTCGAAAACGAGCAGTGCTTCAAGA

AGTTCGCCGAGGTCGTCGAGGACCTTCCTTACCTCAAGGCCATTGTTTGC

TGGGACTATGAAGCCACAGACATCACGCGCGAGGACGGCTCCGTCGTCGA

GGTCCTCACCTTTGCCGAGTTCCTCAAGCGCGGCGACACCGTCGAGGCGG

CCGCCCTTGACGAGCGCATCTCCAAGATCGAGCCCACCATGTGCGCTGCC

CTTATTTACACCAGCGGTACTACCGGCCGCCCAAGGCCGTTATGATTTC

GCACGACAACCTTGTTTTCGAGGCCAGCGCCGTCGTCCCCAACCTCGGAG

GAGCCTGTACGACCACTGCTGAGGAGCGCATTCTCTCGTACCTGCCTCTC

TCGCACGTCGCTGGTATGATGGTTGATATTATTGCCCCCATCATTGCCAC

CGCCTTCCACAAGGGCCGCATCTGCGTCTGCTTTGCTCGCCCGTACGATT

TGCGCACCGGCACGCTGGGCCAGCGCCTCAACGCCGTGGAGCCCACCATC

TTCCTTGGCGTGCCCCGTGTGTGGGAAAAGATTCAGGAAAAGCTCATGGC

CGTCGGTGCCAAAACCACCGGCCTCAAGAAGAAGCTCTCTACGGCCGCCA

AGAAGCGTGGTCTTGAATTCCAGGAGGAGCAGCAAATCGGCCGCTCCGGT

GCCAACCCTGGCTTTGGCCCCCTTGGCATCTACAAGAAGCTCCTCGGCCT

CATCAAGGGCAAGCTGGGCCTCACCAAGTGCAAGTTTGCCTTTGCTGGTG

CCGCGCCCATGACCCGTGAGACCCTTCAGTACTTTGGCGCGCTGAACATC

AACATTAACGAGGTCTACGGCATGTCCGAGTGCTCCGGTGCCGCCACCTG

GTCCACGGACAAGGCCCACGAGTGGGGCACTGTTGGCTACGAGATGCCCA

GTTGCGAGGTCCGCGTCTTCAAGATTGCCGAGGACGGTACCAAGACCGAG

TGCCCGCGCGCCGCCGACATTATGCATGCTACCGAGGAGGAGCAGGGCGA

AGTTTGCTTCCGCGGCCGTAACATCATGATGGGCTACCTTGCCAACCCCA

AGCTTGGCGACGACCACGTTGCCGAGATCGAGGAGAAGAACGCTGCCGCT

ATCGACTCCGAGGGCTGGCTCCACAGTGGTGATAAGGGCGCCATTTCTAC

CCGCGGCATGCTCAAGATCACGGGCCGCTACAAGGAGCTCATCATCGGCG

CCGGTGGCGAGAACGTGGCGCCCGTCCCTATTGAGGACGCCATCAAGGCG

CGCATGCCTTTTGTTTCCAACGCCATGATGGTCGGAGATAAGCGCAAGTT

CATGGCTGTCCTCCTTACCCTCAAGACGGTTGGCGCCACGGGCGAGCTTC

CCGGTACGAACAAGCTCATGGGCGCTGCCGCCGACTATGGTGAGACCATC

GAGGACGCCTGCGACAACGAGGCGCTCATTGAGGAGATCACGCAGCAGCT

CAAGGAGATCGGTGATGATGGCGATGTCACGCCCTCGAACGCGGCTCGCA

TCCAAAAGTTCACCATTCTCCCGCTCGACTTTTCCGTCTCCACGGACGAG

CTCACGGCCACGCTCAAGCTCAAGCGCTCCGTGGTCGCAGACAAGTACGA

AGACATCATCGAGGCCTTTTACGAGTCCAAGAGCGTTTTTGTGCCGTACT

CGACCGTTGGCGCCTACGCCACGGGCGGCCCGGTCGACGACTCCGTTGTC

GATGGCTCCTTCAAGGGCGACTTTAGCATGATTGGCGACGATGATCCGGA

TCTTCAAAACGTCGATGTCCTCGAGGCGATTGACGAGGACAATTAA
```

SEQ ID NO:12 shows the nucleotide sequence of a random "spacer" polynucleotide that is utilized in some embodiments.

SEQ ID NO:13 shows the nucleotide sequence of an exemplary 5' truncated PFA3 gene, referred to herein as PFA3 v3:

```
ATGAGCAAGGAGGAGCTGCTGGACGGCAAGACGGTGGTCTTCGACTACAA

CGAGCTGCTCGAATTCGCCGAGGGCGACGTGGGCCAAGTGTTCGGACCCG

AGTTCGACATCATCGACAAGTACCGGCGTCGCGTGCGGCTGCCGGCGCGC

GAGTACCTGCTCGTGTCGCGCGTGACGCTGATGGACGCCGAGGTGAACAA

CTTCCGCGTCGGGTCGCGCATGGTGACCGAGTACGACGTGCCCGTGAACG

GGGAGCTGTCGGAGGGCGGGGACGTGCCGTGGGCGGTGCTGGTGGAGTCG

GGGCAGTGCGACCTGATGCTCATCTCGTACATGGGCATCGACTTCCAGTG

CAAGGGCGACCGCGTGTACCGCCTGCTCAACACATCGCTCACCTTCTTCG

GGGTGGCGCACGAGGGCGAGACGCTGGTGTACGACATCCGCGTCACGGGG

TTCGCCAAGGGCGCGGGCGGGAGATCTCGATGTTCTTCTTCGAGTACGA

CTGCTTCGTGGACGGCCGCCTGCTGATCGAGATGCGCGACGGGTGCGCCG

GGTTCTTCACGGACGCCGAGCTGGCCGCCGGCAAGGGCGTGCTTAAGACC

AAGGCGGAGCTGGCGGCGCGCGCAGATCCAGAAGCAGGACATCGCGCC

CTTTGCGCCGGCGCCGTGCTCGCACAAGACCTCGCTGGACGCGCGCGAGA

TGCGGCTGCTCGTGGACCGCCAGTGGGCGCGCGTCTTCGGCAGCGGCATG

GCGGGCATCGACTACAAGTTGTGCGCTCGCAAGATGCTCATGATCGACCG

CGTCACGCACCTCGACCCGCGCGGCGGCGCGCACGGCCTCGGGCTGCTGA

TCGGGGAGAAGGTGCTGGAGCGCGACCACTGGTACTTCCCCTGCCACTTT

GTGCGCGACGAGGTGATGGCCGGGTCGCTGGTCAGCGACGGCTGCTCGCA

GCTCCTCAAGGTGTACATGCTGTGGCTCGGCCTGCACACGACCGTGGGCG
```

```
CGTTCGACTTTCGTCCCGTGAGCGGGCACGCCAACAAGGTGCGGTGCCGC
GGGCAGATCTCACCGCACAAGGGCAAGCTCGTGTACGTGATGGAGATCAA
GGAAATGGGCTTTGACGCGAAGACGGGCGATCCGTTTGCGATCGCGGACG
TGGACATCATCGACGTCAACTTCGAGGAGGGACAGGCGTTTGCGGGAGTG
GAAGACCTGCACAGCTACGGCCAGGGCGACCTCCGCAAGAAGATCGTCGT
CGACTTCAAGGGCATCGCGCTCTCCCTGCAGAAGCGGAAGGAGCAGCAGA
AGGAAAGCATGACCGTGACTACGACGACGACGACGAGCCGGGTGATT
GCGCCGCCCAGCGGGTGCCTCAAGGGCGACCCGACGGCGCCGACGAGCGT
GACGTGGCACCCGATGGCGGAGGGCAACGGCGGGCCCGGACCGACGCCGT
CGTTCTCGCCGTCCGCGTACCCGCCGGGCGGTGTGCTTCTCGCCGTTC
CCCAACAACCCGCTTGACAACGACCACACGCCGGGCCAGATGCCGTTGAC
CTGGTTCAACATGTCCGAATTCATGTGCGGCAAAGTGTCCAACTGCCTGG
GCCCCGAGTTTGCGCGCTTCGACGCGAGCAAGACGAGCCGCAGCCCGGCC
TTTGACCTGGCGCTCGTGACGCGGGTGACGAGCGTGGCGGACATGGAGCA
CGGGCCGTTCTACAACGTGGACGTCAACCCGGGCCAGGGCACGATGGTGG
GCGAGTTCGACTGTCCCGCGGACGCGTGGTTCTTCGGCGCCTCGAGCCGC
GACGACCACATGCCGTACTCGATCCTGATGGAGATCGCGCTGCAGACGTC
GGGCGTCCTCACCTCGGTGCTCAAGGCGCCGCTGACGATGGACAAGGACG
ACATCCTCTTCCGCAACCTCGACGCAGACGCCGAGCTCGTGGGCGACGCC
ATGCCGGACGTGCGCGGCAAGACGATCCGCAACTTCACCAAGTGCACAGG
CTACAGCATGCTCGGCAAGATGGGCATCCACCGCTTCACCTTTGAGCTCA
GCGTCGACGGCGCCGTCTTCTACAAGGGCAGCACCTCGTTTGGCTGGTTC
GTCCCCGAGGTCTTCGAGTCGCAGACCGGTCTCGACAACGGCAAGCCGCG
CCTGCCTTGGTACCGCGAGAACAACGTCGCCGTCGACACGCTCTCCGCGC
CCGCCTCCGCTTCCTCCGCGCAAGGTCAGCTGCAGCTGCAGCGACGCGGG
TCGCAGGCGCAGTTCCTGGACACAATCCACCTGGCGGGCAGCGGCGCCGG
CGTGCACGGCCAGGGCTACGCGCACGGGGAGAAGGCCGTGAACAAGCAAG
ATTGGTTCTTCTCGTGCCACTTCTGGTTCGACCCCGTGATGCCCGGGTCC
CTGGGCATCGAGTCGATGTTCCAGCTCGTCGAGGCGTGGTGCGTGAAGCA
GGGACTCGCGGCGCGGCACGGCATCGCTCACCCAGTGTTCGCGCACGCGC
CCGGGGCCACGAGCTGGAAGTACCGCGGGCAGCTAACCCCCAAGAACGAC
GCATGGACAGCGAGGTGCACATCAAGTCGGTGGCGGCCTTCTCCTCCTG
GGTCGACGTCGTCGCGGACGGGTTCCTCTTCGTCGACGGCCTCCGCGTCT
ACTCGGCAGACAACCTCCGCGTCCGCATCCAGACCGGCGCCGGCCACGTT
GAAGAGCAAGAGGTTGCTGCCAAGGCCACAACCAAGAACAGCAGTATTGC
TGATGTGGACGTGGCGGACCTGCAAGCGCTCAAGCAGGCGTTGCTGACGC
TGGAGCGACCGCTGCAGCTGGACGCGGGAGCGAGGTGCCCGCCTGCGCG
GTGAGCGACCTGGGCGATAGGGCTTCATGGAGACGTACGGGGTGGTGGC
GCCGCTGTACAGCGGGGCGATGGCCAAGGGCATCGCGTCGGCGGACCTGG
TGATCGCGATGGGCCAGCGCAAGATGCTGGGGTCGTTTGGCGCGGGCGGG
CTCCCGATGCACGTCGTGCGCGCGGGGATTGAGAAGATCCAGGCAGCGCT
GCCAGCGGGGCCATACGCGGTCAACCTGATTCACTCGCCTTTTGACGCCA
ACCTGGAGAAGGGCAACGTGGACCTCTTCCTGGAGAAGGGCGTGCGCGTC
GTGGAGGCGTCGGCCTTCATGGAGCTCACGCCCCAGGTGGTGCGCTACCG
CGCGACGGGCCTCTCTCGCGACGCGCGCGGCGGCTCCGTGCGCACGGCCC
ACAAGATCATCGGCAAGGTCAGCCGCACCGAGCTGGCCGAGATGTTTATC
CGGCCCGCGCCGCAAGCCATTCTCGACAAGCTTGTGGCGTCCGGCGAGAT
CACCCCCGAGCAGGCGGCGCTGGCGCTCGAGGTGCCCATGGCGGACGACA
TCGCCGTCGAGGCCGATTCGGGCGGGCACACCGACAACCGCCCCATCCAC
GTCATCCTGCCCCTCATCCTCAGCCTGCGCAACCGCCTCCAGCGCGAGCT
CAAGTACCCTGCGCGACACCGCGTGCGCGTCGGCGCCGGGGCGGCATCG
GGTGCCCGCAAGCGGCTCTGGGCGCCTTCCACATGGGCGCCGCGTTTGTG
GTGACGGGCACGGTCAACCAGCTGAGCCGGCAGGCCGGGACATGCGACAA
TGTGCGGCGGCAGCTGTCGCGCGCGACGTACTCGGACATCACGATGGCGC
CGGCGGCGGACATGTTCGAGCAGGGCGTCGAGCTGCAGGTGCTCAAGAAG
GGCACGATGTTTCCCTCGCGCGCCAAGAAGCTGTTCGAGCTGTTTCACAA
GTACGACTCGTTCGAGGCGATGCCGGCGGACGAGCTGGCGCGCGTCGAGA
AGCGCATCTTCAGCAAGTCACTCGCCGAGGTGTGGGCCGAGACCAAGGAC
TTCTACATCACGCGGCTCAACAACCCGGAGAAGATCCGCAAGGCGGAGAA
CGAGGACCCCAAGCTCAAGATGTCACTCTGCTTCCGCTGGTACCTCGGGC
TCAGCTCGTTCTGGGCCAACAACGGCATCGCGGACCGCACGATGGACTAC
CAGATCTGGTGCGGCCCTGCCATCGGCGCCTTCAACGACTTCATCGCCGA
CTCGTACCTCGACGTGGCCGTCTCGGGCGAGTTCCCCGACGTCGTGCAGA
TCAACCTGCAGATCCTGTCGGGCGCAGCCTACCTCCAGCGCCTCCTCTCC
GTCAAGCTCGCACCGCGGATCGACGTCGACACCGAGGACGACCTCTTCAC
CTACCGCCCCGACCACGCACTCTAA
```

SEQ ID NO:14 shows the amino acid sequence of an exemplary 5' truncated PFA3 protein (PFA3v3):

```
MSKEELLDGKTVVFDYNELLEFAEGDVGQVFGPEFDIIDKYRRRVRLPAR
EYLLVSRVTLMDAEVNNFRVGSRMVTEYDVPVNGELSEGGDVPWAVLVES
GQCDLMLISYMGIDFQCKGDRVYRLLNTSLTFFGVAHEGETLVYDIRVTG
FAKGAGGEISMFFFEYDCFVDGRLLIEMRDGCAGFFTDAELAAGKGVLKT
KAELAARAQIQKQDIAPFAPAPCSHKTSLDAREMRLLVDRQWARVFGSGM
AGIDYKLCARKMLMIDRVTHLDPRGGAHGLGLLIGEKVLERDHWYFPCHF
VRDEVMAGSLVSDGCSQLLKVYMLWLGLHTTVGAFDFRPVSGHANKVRCR
GQISPHKGKLVYVMEIKEMGFDAKTGDPFAIADVDIIDVNFEEGQAFAGV
EDLHSYGQGDLRKKIVVDFKGIALSLQKRKEQQKESMTVTTTTTTSRVI
APPSGCLKGDPTAPTSVTWHPMAEGNGGPGPTPSFSPSAYPPRAVCFSPF
PNNPLDNDHTPGQMPLTWFNMSEFMCGKVSNCLGPEFARFDASKTSRSPA
FDLALVTRVTSVADMEHGPFYNVDVNPGQGTMVGEFDCPADAWFFGASSR
DDHMPYSILMEIALQTSGVLTSVLKAPLTMDKDDILFRNLDADAELVGDA
```

-continued

MPDVRGKTIRNFTKCTGYSMLGKMGIHRFTFELSVDGAVFYKGSTSFGWF

VPEVFESQTGLDNGKPRLPWYRENNVAVDTLSAPASASSAQGQLQLQRRG

SQAQFLDTIHLAGSGAGVHGQGYAHGEKAVNKQDWFFSCHFWFDPVMPGS

LGIESMFQLVEAWCVKQGLAARHGIAHPVFAHAPGATSWKYRGQLTPKND

RMDSEVHIKSVAAFSSWVDVVADGFLFVDGLRVYSADNLRVRIQTGAGHV

EEQEVAAKATTKNSSIADVDVADLQALKQALLTLERPLQLDAGSEVPACA

VSDLGDRGFMETYGVVAPLYSGAMAKGIASADLVIAMGQRKMLGSFGAGG

LPMHVVRAGIEKIQAALPAGPYAVNLIHSPFDANLEKGNVDLFLEKGVRV

VEASAFMELTPQVVRYRATGLSRDARGGSVRTAHKIIGKVSRTELAEMFI

RPAPQAILDKLVASGEITPEQAALALEVPMADDIAVEADSGGHTDNRPIH

VILPLILSLRNRLQRELKYPARHRVRVGAGGGIGCPQAALGAFHMGAAFV

VTGTVNQLSRQAGTCDNVRRQLSRATYSDITMAPAADMFEQGVELQVLKK

GTMFPSRAKKLFELFHKYDSFEAMPADELARVEKRIFSKSLAEVWAETKD

FYITRLNNPEKIRKAENEDPKLKMSLCFRWYLGLSSFWANNGIADRTMDY

QIWCGPAIGAFNDFIADSYLDVAVSGEFPDVVQINLQILSGAAYLQRLLS

VKLAPRIDVDTEDDLFTYRPDHAL

SEQ ID NOs:15-38 show the nucleotide sequences of several plasmids utilized in certain examples herein.

DETAILED DESCRIPTION

I. Overview of Several Embodiments

The classical pathway for synthesis of LC-PUFAs in eukaryotic organisms involves the elongation and desaturation of saturated or mono-unsaturated fatty acids. The pathway for synthesis of LC-PUFAs via a PUFA synthase is very different from the classical pathway. Specifically, PUFA synthases utilize malonyl-CoA as a carbon source, and produce the final PUFA(s) without releasing intermediates in any significant amount. Also, with PUFA synthases, the appropriate cis double bonds are added during the synthesis using a mechanism that does not require oxygen. For example, NADPH may be used as a reductant during the synthesis cycle.

Described herein are relatively inexpensive compositions and methods for the efficient and effective production of longer-chain or more unsaturated PUFAs (as well as quantities of lipids, e.g., TAG and PLs, enriched in such PUFAs) in plants, plant seed, or plant oil. Such fatty acids and methods of their production are useful in a variety of contexts, including dietary and industrial applications. A system for providing and improving PUFA production in host organisms (e.g., plants) by providing recombinant host organisms genetically modified with a PUFA synthase system (for example, containing PUFA synthase components identified from Thraustochytrid *Schizochytrium* alga and a phosphopantetheinyl transferase (HetI) from the cyanobacteria genus, *Nostoc*, for example, also containing a *Schizochytrium* acyl-CoA synthetase isozyme 2), as described herein, provides significant benefits over conventional approaches for obtaining these fatty acids.

The marine Thraustochytrid *Schizochytrium* alga (as represented by ATCC Accession No. PTA-9695) produces oil with a high ω-3/ω-6 ratio that may also be used as sources of PUFA synthase genes for crop transformations. Additionally, the *Schizochytrium* can produce oil that contains significant levels of EPA in addition to DHA. The ability to produce significant amounts of EPA is in contrast to some other Thraustochytrium strains (for example, *Schizochytrium* sp. ATCC Accession No. 20888). U.S. Patent Publication No. US2013/0150599A1; PCT International Patent Publication No. WO2013/016546. The *Schizochytrium* PUFA synthase system may function when heterologously expressed in a wide variety of crop plants, as demonstrated herein by example in canola, soybean, and the model plant, *Arabidopsis*, to make commercially significant levels of ω-3 LC-PUFAs (e.g., DHA and EPA). Accordingly, this gene set may in some embodiments lead to the production of significantly more DHA and EPA than other PUFA synthase gene sets in plants.

Also described herein is the utility of various construct designs, including diversification of different seed-specific promoters and terminators, the use of spacer elements, altered transcriptional orientations, different relative positioning of genes within the T-DNA, and the use of native and modified gene sequences. These construct designs may be used to further improve the number of LC-PUFA-producing events recovered, and the heritability of the ω-3 LC-PUFA trait in subsequent generations.

In examples herein, canola, soy, and *Arabidopsis* plants were transformed with vectors harboring genes encoding three component polypeptides of PUFA synthase (i.e., PFA1, PFA2, and PFA3) from Thraustochytrid *Schizochytrium* alga, together with a phosphopantetheinyl transferase (HetI) from *Nostoc*. In some examples, all four genes were contained within a single construct under the control of a seed-specific promoter, and were driven by a variety of seed-specific promoters in various configurations. Plant transformation experiments generated events that contained all four transgenes and expressed all four polypeptides in the seed. The ω-3 LC-PUFAs DHA and EPA were produced in seed lipids from the resulting transgenic events. The ω-6 LC-PUFA DPA was also detected. Canola events were recovered containing up to 2.9% DHA and 1.0% EPA (3.9% total ω-3 LC-PUFA) and 1.1% DHA+2.0% EPA in bulk analyses of $T_1$ seed. Up to 4.6% DHA and 3.7% EPA was detected in single-seed analyses of $T_1$ canola seed. Soybean events were recovered containing up to 1.9% DHA and 2.2% EPA in single seed analyses of $T_1$ seed.

II. Abbreviations

ACS acetyl-CoA synthetase
DGAT diacylglycerol acyltransferase
DHA docosahexaenoic acid
DPA docosapentaenoic acid
EPA eicosapentaenoic acid
FAME fatty acid methyl ester
HPLC high-performance liquid chromatography
LC-PUFA long chain polyunsaturated fatty acid
LPAT lysophosphatidyl acyltransferase
LPCAT lysophosphatidylcholine acyltransferase
P1P2P3H PFA1, PFA2, and PFA3 genes expressed with HetI
P1P2P3H-ACS PFA1, PFA2, and PFA3 genes expressed with HetI and SzACS2
PDAT phospholipid: diacylglycerol acyltransferase
PL phospholipid
PPTase phosphopantetheine transferase
PTU plant transcription unit
PUFA polyunsaturated fatty acid
SzACS2 *Schizochytrium* acyl-CoA synthetase isozyme 2
TAG triacylglycerol

III. Terms

Backcrossing: Backcrossing methods may be used to introduce a nucleic acid sequence into plants. The backcrossing technique has been widely used for decades to introduce new traits into plants. Jensen, N., Ed. *Plant Breeding Methodology*, John Wiley & Sons, Inc., 1988. In a typical backcross protocol, the original variety of interest (recurrent parent) is crossed to a second variety (non-recurrent parent) that carries a gene of interest to be transferred. The resulting progeny from this cross are then crossed again to the recurrent parent, and the process is repeated until a plant is obtained wherein essentially all of the desired morphological and physiological characteristics of the recurrent plant are recovered in the converted plant, in addition to the transferred gene from the non-recurrent parent.

Isolated: An "isolated" biological component (such as a nucleic acid or protein) has been substantially separated, produced apart from, or purified away from other biological components in the cell of the organism in which the component naturally occurs (i.e., other chromosomal and extra-chromosomal DNA and RNA, and proteins), while effecting a chemical or functional change in the component (e.g., a nucleic acid may be isolated from a chromosome by breaking chemical bonds connecting the nucleic acid to the remaining DNA in the chromosome). Nucleic acid molecules and proteins that have been "isolated" include nucleic acid molecules and proteins purified by standard purification methods. The term also embraces nucleic acids and proteins prepared by recombinant expression in a host cell, as well as chemically-synthesized nucleic acid molecules, proteins, and peptides.

Nucleic acid molecule: As used herein, the term "nucleic acid molecule" may refer to a polymeric form of nucleotides, which may include both sense and anti-sense strands of RNA, cDNA, genomic DNA, and synthetic forms and mixed polymers of the above. A nucleotide may refer to a ribonucleotide, deoxyribonucleotide, or a modified form of either type of nucleotide. A "nucleic acid molecule," as used herein, is synonymous with "nucleic acid" and "polynucleotide." A nucleic acid molecule is usually at least 10 bases in length, unless otherwise specified. The term includes single- and double-stranded forms of DNA. A nucleic acid molecule can include either or both naturally occurring and modified nucleotides linked together by naturally occurring and/or non-naturally occurring nucleotide linkages.

Nucleic acid molecules may be modified chemically or biochemically, or may contain non-natural or derivatized nucleotide bases, as will be readily appreciated by those of skill in the art. Such modifications include, for example, labels, methylation, substitution of one or more of the naturally occurring nucleotides with an analog, internucleotide modifications (e.g., uncharged linkages: for example, methyl phosphonates, phosphotriesters, phosphoramidates, carbamates, etc.; charged linkages: for example, phosphorothioates, phosphorodithioates, etc.; pendent moieties: for example, peptides; intercalators: for example, acridine, psoralen, etc.; chelators; alkylators; and modified linkages: for example, alpha anomeric nucleic acids, etc.). The term "nucleic acid molecule" also includes any topological conformation, including single-stranded, double-stranded, partially duplexed, triplexed, hairpinned, circular, and padlocked conformations.

Operably linked: A first nucleotide sequence is operably linked with a second nucleic acid sequence when the first nucleic acid sequence is in a functional relationship with the second nucleic acid sequence. When recombinantly produced, operably linked nucleic acid sequences are generally contiguous, and, where necessary to join two protein-coding regions, in the same reading frame (e.g., in a polycistronic ORF). However, nucleic acids need not be contiguous to be operably linked.

The term, "operably linked," when used in reference to a regulatory sequence and a coding sequence, means that the regulatory sequence affects the expression of the linked coding sequence. "Regulatory sequences," or "control elements," refer to nucleotide sequences that influence the timing and level/amount of transcription, RNA processing or stability, or translation of the associated coding sequence. Regulatory sequences may include promoters; translation leader sequences; introns; enhancers; stem-loop structures; repressor binding sequences; termination sequences; and polyadenylation recognition sequences. Particular regulatory sequences may be located upstream and/or downstream of a coding sequence operably linked thereto. Also, particular regulatory sequences operably linked to a coding sequence may be located on the associated complementary strand of a double-stranded nucleic acid molecule.

Promoter: As used herein, the term "promoter" refers to a region of DNA that may be upstream from the start of transcription, and that may be involved in recognition and binding of RNA polymerase and other proteins to initiate transcription. A promoter may be operably linked to a coding sequence for expression in a cell, or a promoter may be operably linked to a nucleotide sequence encoding a signal sequence which may be operably linked to a coding sequence for expression in a cell. A "plant promoter" may be a promoter capable of initiating transcription in plant cells. Examples of promoters under developmental control include promoters that preferentially initiate transcription in certain tissues, such as leaves, roots, seeds, fibers, xylem vessels, tracheids, or sclerenchyma. Such promoters are referred to as "tissue-preferred." Promoters which initiate transcription only in certain tissues are referred to as "tissue-specific." A "cell type-specific" promoter primarily drives expression in certain cell types in one or more organs, for example, vascular cells in roots or leaves. An "inducible" promoter may be a promoter which may be under environmental control. Examples of environmental conditions that may initiate transcription by inducible promoters include anaerobic conditions and the presence of light. Tissue-specific, tissue-preferred, cell type specific, and inducible promoters constitute the class of "non-constitutive" promoters. A "constitutive" promoter is a promoter which may be active in most cells of the organism under most environmental conditions.

Any inducible promoter can be used in some embodiments of the invention. See Ward et al. (1993) Plant Mol. Biol. 22:361-366. With an inducible promoter, the rate of transcription increases in response to an inducing agent. Exemplary inducible promoters include, but are not limited to: Promoters from the ACEI system that responds to copper; In2 gene from maize that responds to benzenesulfonamide herbicide safeners; Tet repressor from Tn10; and the inducible promoter from a steroid hormone gene, the transcriptional activity of which may be induced by a glucocorticosteroid hormone (Schena et al. (1991) Proc. Natl. Acad. Sci. USA 88:0421).

Exemplary constitutive promoters include, but are not limited to: Promoters from plant viruses, such as the 35S promoter from CaMV; promoters from rice actin genes; ubiquitin promoters; pEMU; MAS; maize H3 histone promoter; and the ALS promoter, XbaI/NcoI fragment 5' to the *Brassica napus* ALS3 structural gene (or a nucleotide sequence similarity to said XbaI/NcoI fragment) (International Patent Publication No. WO 96/30530).

Additionally, any tissue-specific or tissue-preferred promoter may be utilized in some embodiments of the invention. Plants transformed with a nucleic acid molecule comprising a coding sequence operably linked to a tissue-specific promoter may produce the product of the coding sequence exclusively, or preferentially, in a specific tissue. Exemplary tissue-specific or tissue-preferred promoters include, but are not limited to: a root-preferred promoter, such as that from the phaseolin gene; a leaf-specific and light-induced promoter such as that from cab or rubisco; an anther-specific promoter such as that from LAT52; a pollen-specific promoter such as that from Zm13; a microspore-preferred promoter such as that from apg, and a seed specific promoter (e.g., a promoter from PvDlec2,LfKCS3,FAE1, BoACP, or BnaNapinC).

Heterologous: The term "heterologous," as applied to nucleic acids (e.g., polynucleotides, DNA, RNA, and genes) herein, means of different origin. For example, if a host cell is transformed with a nucleic acid that does not occur in the untransformed host cell in nature, then that nucleic acid is heterologous (and exogenous) to the host cell. Furthermore, different elements (e.g., promoter, enhancer, coding sequence, terminator, etc.) of a transforming nucleic acid may be heterologous to one another and/or to the transformed host. The term heterologous, as used herein, may also be applied to one or more nucleic acid(s) that are identical in sequence to a nucleic acid already present in a host cell, but that are now linked to different additional sequences and/or are present at a different copy number, etc.

Native: As used herein, the term "native" refers to the form of a polynucleotide or gene in its natural location in the organism or in the genome of an organism as found in nature, with its own regulatory sequences, if present.

Endogenous: As used herein, the term "endogenous" refers to a polynucleotide, gene, or polypeptide that is located in the organism or genome that normally comprises the molecule in nature.

Transformation: As used herein, the term "transformation" or "transduction" refers to the transfer of one or more nucleic acid molecule(s) into a cell. A cell is "transformed" by a nucleic acid molecule transduced into the cell when the nucleic acid molecule becomes stably replicated by the cell, either by incorporation of the nucleic acid molecule into the cellular genome, or by episomal replication. As used herein, the term "transformation" encompasses all techniques by which a nucleic acid molecule can be introduced into such a cell. Examples include, but are not limited to: transfection with viral vectors; transformation with plasmid vectors; electroporation (Fromm et al. (1986) Nature 319:791-3); lipofection (Felgner et al. (1987) Proc. Natl. Acad. Sci. USA 84:7413-7); microinjection (Mueller et al. (1978) Cell 15:579-85); *Agrobacterium*-mediated transfer (Fraley et al. (1983) Proc. Natl. Acad. Sci. USA 80:4803-7); direct DNA uptake; and microprojectile bombardment (Klein et al. (1987) Nature 327:70).

Transgene: An exogenous nucleic acid sequence that is integrated into the genome of the host. In some examples, a transgene may contain regulatory sequences operably linked to a coding sequence of the transgene (e.g., a promoter).

Vector: A nucleic acid molecule as introduced into a cell, for example, to produce a transformed cell. A vector may include nucleic acid sequences that permit it to replicate in the host cell, such as an origin of replication. Examples of vectors include, but are not limited to: a plasmid; cosmid; bacteriophage; or virus that carries exogenous DNA into a cell. A vector may also include one or more genes, antisense molecules, and/or selectable marker genes and other genetic elements known in the art. A vector may transduce, transform, or infect a cell, thereby causing the cell to express the nucleic acid molecules and/or proteins encoded by the vector. A vector optionally includes materials to aid in achieving entry of the nucleic acid molecule into the cell (e.g., a liposome, and protein coating).

Expression: As used herein, the term "expression" may refer to the transcription and stable accumulation of mRNA encoded by a polynucleotide, or to the translation of such an mRNA into a polypeptide. The term "over-expression," as used herein, refers to expression that is higher than endogenous expression of the same or a closely related gene. A heterologous gene is over-expressed if its expression is higher than that of a closely-related endogenous gene (e.g., a homolog).

Exogenous: The term "exogenous," as applied to nucleic acids (e.g., polynucleotides, DNA, RNA, and genes) herein, refers to one or more nucleic acid(s) that are not normally present within their specific environment or context. For example, if a host cell is transformed with a nucleic acid that does not occur in the untransformed host cell in nature, then that nucleic acid is exogenous to the host cell. The term exogenous, as used herein, also refers to one or more nucleic acid(s) that are identical in sequence to a nucleic acid already present in a host cell, but that are located in a different cellular or genomic context than the nucleic acid with the same sequence already present in the host cell. For example, a nucleic acid that is integrated in the genome of the host cell in a different location than a nucleic acid with the same sequence is normally integrated in the genome of the host cell is exogenous to the host cell. Furthermore, a nucleic acid (e.g., a DNA molecule) that is present in a plasmid or vector in the host cell is exogenous to the host cell when a nucleic acid with the same sequence is only normally present in the genome of the host cell.

Sequence identity: The term "sequence identity" or "identity," as used herein, in the context of two nucleic acid or polypeptide sequences, may refer to the residues in the two sequences that are the same when aligned for maximum correspondence over a specified comparison window.

As used herein, the term "percentage of sequence identity" may refer to the value determined by comparing two optimally aligned sequences (e.g., nucleic acid sequences, and amino acid sequences) over a comparison window, wherein the portion of the sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleotide or amino acid residue occurs in both sequences to yield the number of matched positions, dividing the number of matched positions by the total number of positions in the comparison window, and multiplying the result by 100 to yield the percentage of sequence identity.

Methods for aligning sequences for comparison are well-known in the art. Various programs and alignment algorithms are described in, for example: Smith and Waterman (1981) Adv. Appl. Math. 2:482; Needleman and Wunsch (1970) J. Mol. Biol. 48:443; Pearson and Lipman (1988) Proc. Natl. Acad. Sci. U.S.A. 85:2444; Higgins and Sharp (1988) Gene 73:237-44; Higgins and Sharp (1989) CABIOS 5:151-3; Corpet et al. (1988) Nucleic Acids Res. 16:10881-90; Huang et al. (1992) Comp. Appl. Biosci. 8:155-65; Pearson et al. (1994) Methods Mol. Biol. 24:307-31; Tatiana et al. (1999) FEMS Microbiol. Lett. 174:247-50. A detailed consideration of sequence alignment methods and homology calculations can be found in, e.g., Altschul et al. (1990) J. Mol. Biol. 215:403-10.

The National Center for Biotechnology Information (NCBI) Basic Local Alignment Search Tool (BLAST™; Altschul et al. (1990)) is available from several sources, including the National Center for Biotechnology Information (Bethesda, Md.), and on the internet, for use in connection with several sequence analysis programs. A description of how to determine sequence identity using this program is available on the internet under the "help" section for BLAST™. For comparisons of nucleic acid sequences, the "Blast 2 sequences" function of the BLAST™ (Blastn) program may be employed using the default parameters. Nucleic acid sequences with even greater similarity to the reference sequences will show increasing percentage identity when assessed by this method.

As used herein, the term "substantially identical" may refer to nucleotide sequences that are more than 85% identical. For example, a substantially identical nucleotide sequence may be at least 85.5%; at least 86%; at least 87%; at least 88%; at least 89%; at least 90%; at least 91%; at least 92%; at least 93%; at least 94%; at least 95%; at least 96%; at least 97%; at least 98%; at least 99%; or at least 99.5% identical to the reference sequence.

In some embodiments, the presence of a heterologous nucleic acid in a plant may be detected through the use of a nucleic acid probe. A probe may be a DNA molecule or an RNA molecule. RNA probes can be synthesized by means known in the art, for example, using a DNA molecule template. A probe may contain all or a portion of the nucleotide sequence of the heterologous nucleic acid and additional, contiguous nucleotide sequence from the plant genome. This is referred to herein as a "contiguous probe." The additional, contiguous nucleotide sequence is referred to as "upstream" or "downstream" of the heterologous nucleic acid, depending on whether the contiguous nucleotide sequence from the plant chromosome is on the 5' or the 3' side of the heterologous nucleic acid, as conventionally understood. As is recognized by those of ordinary skill in the art, the process of obtaining additional, contiguous nucleotide sequence for inclusion in a probe may be repeated nearly indefinitely (limited only by the length of the chromosome), thereby identifying additional nucleic acid along the chromosome. Any and all of the above-described varieties of probes may be used in some embodiments of the present invention.

A probe may contain a nucleotide sequence that is not contiguous to that of the heterologous nucleic acid; this probe is referred to herein as a "noncontiguous probe." The sequence of the noncontiguous probe is located sufficiently close to the sequence of the heterologous nucleic acid on the chromosome so that the noncontiguous probe is genetically linked to the heterologous nucleic acid. A probe may also be an exact copy of a heterologous nucleic acid to be detected. A probe may also be a nucleic acid molecule comprising, or consisting of, a nucleotide sequence that is substantially identical to a cloned segment of chromosomal DNA comprising a heterologous nucleic acid to be detected.

An oligonucleotide probe sequence may be prepared synthetically or by cloning. Suitable cloning vectors are well-known to those of skill in the art. An oligonucleotide probe may be labeled or unlabeled. A wide variety of techniques exist for labeling nucleic acid molecules, including, for example and without limitation: Radiolabeling by nick translation; random priming; tailing with terminal deoxytransferase; etc., where the nucleotides employed are labeled, for example, with radioactive $^{32}$P. Other labels which may be used include, for example and without limitation: Fluorophores; enzymes; enzyme substrates; enzyme cofactors; enzyme inhibitors; etc. Alternatively, the use of a label that provides a detectable signal, by itself or in conjunction with other reactive agents, may be replaced by ligands to which receptors bind, where the receptors are labeled (for example, by the above-indicated labels) to provide detectable signals, either by themselves, or in conjunction with other reagents. See, e.g., Leary et al. (1983) Proc. Natl. Acad. Sci. USA 80:4045-9.

A probe may also be a nucleic acid molecule that is "specifically hybridizable" or "specifically complementary" to an exact copy of the nucleic acid to be detected ("DNA target"). "Specifically hybridizable" and "specifically complementary" are terms that indicate a sufficient degree of complementarity such that stable and specific binding occurs between the nucleic acid molecule and the DNA target. A nucleic acid molecule need not be 100% complementary to its target sequence to be specifically hybridizable. A nucleic acid molecule is specifically hybridizable when there is a sufficient degree of complementarity to avoid non-specific binding of the nucleic acid to non-target sequences under conditions where specific binding is desired, for example, under stringent hybridization conditions.

Hybridization conditions resulting in particular degrees of stringency will vary depending upon the nature of the hybridization method of choice and the composition and length of the hybridizing nucleic acid sequences. Generally, the temperature of hybridization and the ionic strength (especially the $Na^+$ and/or $Mg^{++}$ concentration) of the hybridization buffer will determine the stringency of hybridization, though wash times also influence stringency. Calculations regarding hybridization conditions required for attaining particular degrees of stringency are known to those of ordinary skill in the art, and are discussed, for example, in Sambrook et al. (ed.) *Molecular Cloning: A Laboratory Manual*, $2^{nd}$ ed., vol. 1-3, Cold Spring Harbor Laboratory Press, Cold Spring Harbor, N.Y., 1989, chapters 9 and 11; and Hames and Higgins (eds.) *Nucleic Acid Hybridization*, IRL Press, Oxford, 1985. Further detailed instruction and guidance with regard to the hybridization of nucleic acids may be found, for example, in Tijssen, "Overview of principles of hybridization and the strategy of nucleic acid probe assays," in *Laboratory Techniques in Biochemistry and Molecular Biology—Hybridization with Nucleic Acid Probes*, Part I, Chapter 2, Elsevier, N Y, 1993; and Ausubel et al., Eds., *Current Protocols in Molecular Biology*, Chapter 2, Greene Publishing and Wiley-Interscience, N Y, 1995.

As used herein, "stringent conditions" encompass conditions under which hybridization will only occur if there is less than 25% mismatch between the hybridization molecule and the DNA target. "Stringent conditions" include further particular levels of stringency. Thus, as used herein, "moderate stringency" conditions are those under which molecules with more than 25% sequence mismatch will not hybridize; conditions of "medium stringency" are those under which molecules with more than 15% mismatch will not hybridize; and conditions of "high stringency" are those under which sequences with more than 10% mismatch will not hybridize. Conditions of "very high stringency" are those under which sequences with more than 6% mismatch will not hybridize.

In particular embodiments, stringent conditions are hybridization at 65° C. in 6× saline-sodium citrate (SSC) buffer, 5×Denhardt's solution, 0.5% SDS, and 100 µg sheared salmon testes DNA, followed by 15-30 minutes sequential washes at 65° C. in 2×SSC buffer and 0.5% SDS, followed by 1×SSC buffer and 0.5% SDS, and finally 0.2×SSC buffer and 0.5% SDS.

With respect to all probes discussed, supra, the probe may comprise additional nucleic acid sequences, for example, promoters; transcription signals; and/or vector sequences.

Optimized: As used herein, in the context of a nucleic acid encoding a protein, the term "optimized" refers to a nucleic acid wherein a heterologous nucleotide sequence has been changed to reflect the codon bias of a target host organism. In some embodiments, the nucleotide sequence may be further changed to remove genetic elements that may interfere with gene expression.

It will be understood that, due to the redundancy of the genetic code, multiple DNA sequences may be designed to encode a single amino acid sequence. Thus, optimized DNA sequences may be designed, for example, to remove superfluous restriction sites and undesirable RNA secondary structures, while optimizing the nucleotide sequence of the coding region so that the codon composition resembles the overall codon composition of the host in which the DNA is to be expressed. Guidance regarding the design and production of synthetic DNA sequences can be found in, for example, International Patent Application Nos. WO2013016546, WO2011146524, and WO1997013402; and U.S. Pat. Nos. 6,166,302 and 5,380,831.

Conservative substitution: As used herein, the term "conservative substitution" refers to a substitution where an amino acid residue is substituted for another amino acid in the same class. A non-conservative amino acid substitution is one where the residues do not fall into the same class, for example, substitution of a basic amino acid for a neutral or non-polar amino acid. Classes of amino acids that may be defined for the purpose of performing a conservative substitution are known in the art.

In some embodiments, a conservative substitution includes the substitution of a first aliphatic amino acid for a second, different aliphatic amino acid. For example, if a first amino acid is one of Gly; Ala; Pro; Ile; Leu; Val; and Met, the first amino acid may be replaced by a second, different amino acid selected from Gly; Ala; Pro; Ile; Leu; Val; and Met. In particular examples, if a first amino acid is one of Gly; Ala; Pro; Ile; Leu; and Val, the first amino acid may be replaced by a second, different amino acid selected from Gly; Ala; Pro; Ile; Leu; and Val. In particular examples involving the substitution of hydrophobic aliphatic amino acids, if a first amino acid is one of Ala; Pro; Ile; Leu; and Val, the first amino acid may be replaced by a second, different amino acid selected from Ala; Pro; Ile; Leu; and Val.

In some embodiments, a conservative substitution includes the substitution of a first aromatic amino acid for a second, different aromatic amino acid. For example, if a first amino acid is one of His; Phe; Trp; and Tyr, the first amino acid may be replaced by a second, different amino acid selected from His; Phe; Trp; and Tyr. In particular examples involving the substitution of uncharged aromatic amino acids, if a first amino acid is one of Phe; Trp; and Tyr, the first amino acid may be replaced by a second, different amino acid selected from Phe; Trp; and Tyr.

In some embodiments, a conservative substitution includes the substitution of a first hydrophobic amino acid for a second, different hydrophobic amino acid. For example, if a first amino acid is one of Ala; Val; Ile; Leu; Met; Phe; Tyr; and Trp, the first amino acid may be replaced by a second, different amino acid selected from Ala; Val; Ile; Leu; Met; Phe; Tyr; and Trp. In particular examples involving the substitution of non-aromatic, hydrophobic amino acids, if a first amino acid is one of Ala; Val; Ile; Leu; and Met, the first amino acid may be replaced by a second, different amino acid selected from Ala; Val; Ile; Leu; and Met.

In some embodiments, a conservative substitution includes the substitution of a first polar amino acid for a second, different polar amino acid. For example, if a first amino acid is one of Ser; Thr; Asn; Gln; Cys; Gly; Pro; Arg; His; Lys; Asp; and Glu, the first amino acid may be replaced by a second, different amino acid selected from Ser; Thr; Asn; Gln; Cys; Gly; Pro; Arg; His; Lys; Asp; and Glu. In particular examples involving the substitution of uncharged, polar amino acids, if a first amino acid is one of Ser; Thr; Asn; Gln; Cys; Gly; and Pro, the first amino acid may be replaced by a second, different amino acid selected from Ser; Thr; Asn; Gln; Cys; Gly; and Pro. In particular examples involving the substitution of charged, polar amino acids, if a first amino acid is one of His; Arg; Lys; Asp; and Glu, the first amino acid may be replaced by a second, different amino acid selected from His; Arg; Lys; Asp; and Glu. In further examples involving the substitution of charged, polar amino acids, if a first amino acid is one of Arg; Lys; Asp; and Glu, the first amino acid may be replaced by a second, different amino acid selected from Arg; Lys; Asp; and Glu. In particular examples involving the substitution of positively charged (basic), polar amino acids, if a first amino acid is one of His; Arg; and Lys, the first amino acid may be replaced by a second, different amino acid selected from His; Arg; and Lys. In further examples involving the substitution of positively charged, polar amino acids, if a first amino acid is Arg or Lys, the first amino acid may be replaced by the other amino acid of Arg and Lys. In particular examples involving the substitution of negatively charged (acidic), polar amino acids, if a first amino acid is Asp or Glu, the first amino acid may be replaced by the other amino acid of Asp and Glu.

In some embodiments, a conservative substitution includes the substitution of a first electrically neutral amino acid for a second, different electrically neutral amino acid. For example, if a first amino acid is one of Gly; Ser; Thr; Cys; Asn; Gln; and Tyr, the first amino acid may be replaced by a second, different amino acid selected from Gly; Ser; Thr; Cys; Asn; Gln; and Tyr.

In some embodiments, a conservative substitution includes the substitution of a first non-polar amino acid for a second, different non-polar amino acid. For example, if a first amino acid is one of Ala; Val; Leu; Ile; Phe; Trp; Pro; and Met, the first amino acid may be replaced by a second, different amino acid selected from Ala; Val; Leu; Ile; Phe; Trp; Pro; and Met.

In many examples, the selection of a particular second amino acid to be used in a conservative substitution to replace a first amino acid may be made in order to maximize the number of the foregoing classes to which the first and second amino acids both belong. Thus, if the first amino acid is Ser (a polar, non-aromatic, and electrically neutral amino acid), the second amino acid may be another polar amino acid (i.e., Thr; Asn; Gln; Cys; Gly; Pro; Arg; His; Lys; Asp; or Glu); another non-aromatic amino acid (i.e., Thr; Asn;

Gln; Cys; Gly; Pro; Arg; His; Lys; Asp; Glu; Ala; Ile; Leu; Val; or Met); or another electrically-neutral amino acid (i.e., Gly; Thr; Cys; Asn; Gln; or Tyr). However, it may be preferred that the second amino acid in this case be one of Thr; Asn; Gln; Cys; and Gly, because these amino acids share all the classifications according to polarity, non-aromaticity, and electrical neutrality. Additional criteria that may optionally be used to select a particular second amino acid to be used in a conservative substitution are known in the art. For example, when Thr; Asn; Gln; Cys; and Gly are available to be used in a conservative substitution for Ser, Cys may be eliminated from selection in order to avoid the formation of undesirable cross-linkages and/or disulfide bonds. Likewise, Gly may be eliminated from selection, because it lacks an alkyl side chain. In this case, Thr may be selected, e.g., in order to retain the functionality of a side chain hydroxyl group. The selection of the particular second amino acid to be used in a conservative substitution is ultimately, however, within the discretion of the skilled practitioner.

PUFA: As used herein, the term "polyunsaturated fatty acid" or "PUFA" refers to a fatty acid with a carbon chain length of at least 16 carbons (e.g., at least 18 carbons, at least 20 carbons, and 22 or more carbons), with at least 3 or more double bonds (e.g., 4 or more double bonds, 5 or more double bonds, and 6 or more double bonds), wherein all double bonds are in the cis configuration.

As used herein, the term "long chain polyunsaturated fatty acid" or "LC-PUFA" refers to a fatty acid with a carbon chain length of 20 or more carbons containing 3 or more double bonds, or 22 or more carbons containing 3 or more double bonds (e.g., 4 or more double bonds, 5 or more double bonds, and 6 or more double bonds). LC-PUFAs of the ω-6 series include, for example, and without limitation, di-homo-gamma-linolenic acid (C20:3 n-6), arachidonic acid (C20:4 n-6), adrenic acid (also called docosatetraenoic acid or DTA; C22:4 n-6), and docosapentaenoic acid (C22:5 n-6). LC-PUFAs of the ω-3 series include, for example and without limitation, eicosatrienoic acid (C20:3 n-3), eicosatetraenoic acid (C20:4 n-3), eicosapentaenoic acid (C20:5 n-3), docosapentaenoic acid (C22:5 n-3), and docosahexaenoic acid (C22:6 n-3). LC-PUFAs also include fatty acids with greater than 22 carbons and 4 or more double bonds, for example and without limitation, C28:8 (n-3).

The term "PUFA synthase" or "PFA," as used herein, refers to an enzyme that produces PUFAs (e.g., LC-PUFAs), as well as a domain of such an enzyme in a system or complex. The term PUFA synthase includes, for example and without limitation, PUFA PKS systems or PKS-like systems for the production of PUFAs. Some specific PUFA synthases are designated herein by an additional notation ("*Schizochytrium* PUFA synthase," PFA1, PFA2, and PFA3; e.g., from *Schizochytrium* sp. ATCC Accession No. PTA-9695). The term "PUFA synthase system" refers to one or more PUFA synthase(s) and any heterologous accessory enzymes that can affect the function of the PUFA synthase (e.g., a PPTase or ACS).

PPTase: The terms "phosphopantetheinyl transferase" or "PPTase," as used herein, refer to an enzyme that activates a PUFA synthase by transferring a cofactor (e.g., 4-phosphopantetheine) from coenzyme A (CoA) to one or more ACP domains present in the PUFA synthase. One example of a PPTase which can activate one or more ACP domains of a PUFA synthase utilized in embodiments herein is the HetI protein of a *Nostoc* sp. (e.g., HetI from PCC 7120; formerly called *Anabaena* sp. PCC 7120), designated herein as "NoHetI."

ACS: As used herein, the term "acyl-CoA synthetase," "ACoAS," or "ACS" refer to an enzyme that catalyzes the conversion of long chain polyunsaturated free fatty acids (FFA) to acyl-CoA. Specific acyl-CoA synthetases utilized in particular embodiments herein, derived from *Schizochytrium* ATCC Accession No. 20888, are referred to by an additional notation; e.g., "SzACS2."

Plant: The term "plant," as used herein, includes any descendant, cell, tissue, seed, seed oil, or part thereof.

Trait or phenotype: The terms "trait" and "phenotype" are used interchangeably herein. For the purposes of the present disclosure, traits of particular interest include the ω-3 LC-PUFA trait, as may be expressed, for example, in an oilseed crop plant.

Functional food: As used herein, the term "functional food" refers to a food that is similar in appearance to a conventional food that is consumed as part of a usual diet and has enhanced nutritional value and/or specific dietary benefits based on a modification in the proportion of components that typically exist in the unmodified source material of the conventional food.

Unless specifically indicated or implied, the terms "a," "an," and "the" signify "at least one," as used herein.

Unless otherwise specifically explained, all technical and scientific terms used herein have the same meaning as commonly understood by those of ordinary skill in the art to which this disclosure belongs. Definitions of common terms in molecular biology can be found in, for example, Lewin B., *Genes V*, Oxford University Press, 1994 (ISBN 0-19-854287-9); Kendrew et al. (eds.), *The Encyclopedia of Molecular Biology*, Blackwell Science Ltd., 1994 (ISBN 0-632-02182-9); and Meyers R. A. (ed.), *Molecular Biology and Biotechnology: A Comprehensive Desk Reference*, VCH Publishers, Inc., 1995 (ISBN 1-56081-569-8). All percentages are by weight and all solvent mixture proportions are by volume unless otherwise noted. All temperatures are in degrees Celsius.

IV. Heterologous PUFA Synthase System

*Schizochytrium* PUFA Synthases

Embodiments herein include host organisms (e.g., plants) that are genetically modified to express a PUFA synthase. In some embodiments, an organism that has been genetically modified to express a heterologous PUFA synthase system, for example, a functional heterologous protein system comprising a PUFA synthase and at least one accessory protein thereof. The genetic modifications herein may also be used in some embodiments to improve PUFA production in a host organism that endogenously expresses a PUFA synthase.

A PUFA synthase system may comprise several multifunctional proteins (and can include single function proteins) that can act together to conduct both iterative processing of the fatty acid chain, as well as non-iterative processing, including trans-cis isomerization and enoyl reduction reactions in selected cycles. These proteins are referred to herein as the core PUFA synthase enzyme system or the core PUFA synthase. General information and details about the domains and motifs contained within these proteins may be found in, for example: U.S. Pat. Nos. 6,140,486 and 6,566,583; U.S. Patent Publication Nos. 2002/0194641, 2004/0235127, and 2005/0100995; International Patent Publication No. WO 2006/135866; and Metz et al. (2001) Science 293:290-3. Functional PUFA synthase domains may be found as a single protein (e.g., the domain and protein are synonymous) or as one of two or more domains in a single protein.

Numerous examples of polypeptides having PUFA synthase activity (and polynucleotides and genes encoding the same) are known in the art and may be combined in a genetically modified host comprising a heterologous PUFA synthase that is disclosed herein. Such PUFA synthase proteins (or domains) include both bacterial and non-bacterial PUFA synthases. A non-bacterial PUFA synthase may be a eukaryotic PFA. Certain bacterial PUFA synthases are described, for example, in U.S. Patent Publication No. 2008/0050505. Genetically modified plants of the invention can be produced which incorporate non-bacterial PUFA synthase functional domains with bacterial PUFA synthase functional domains, as well as PUFA synthase functional domains or proteins from other PKS systems (e.g., Type I iterative or modular, Type II, and Type III) and/or FAS systems.

In some embodiments, a heterologous PUFA synthase comprises biologically active domains that are typically contained on three, four, or more proteins selected from the group consisting of: at least one enoyl-ACP reductase (ER) domain; multiple acyl carrier protein (ACP) domain(s) (e.g., at least from one to four, or at least five ACP domains, and in some embodiments up to six, seven, eight, nine, ten, or more than ten ACP domains); at least two β-ketoacyl-ACP synthase (KS) domains; at least one acyltransferase (AT) domain; at least one β-ketoacyl-ACP reductase (KR) domain; at least two FabA-like β-hydroxyacyl-ACP dehydrase (DH) domains; at least one chain length factor (CLF) domain; and at least one malonyl-CoA:ACP acyltransferase (MAT) domain. In particular embodiments, a heterologous PUFA synthase also comprises at least one region containing a dehydratase conserved active site motif.

In some embodiments, a heterologous PUFA synthase system comprises a PUFA synthase (e.g., PFA1, PFA2, and PFA3) from the Thraustochytrid *Schizochytrium* alga. For example, a heterologous PUFA synthase system according to embodiments herein may include, for example and without limitation, at least one protein comprising an amino acid sequence having at least 80% (e.g., at least 81%; at least 82%; at least 83%; at least 84%; at least 85%; at least 86%; at least 87%; at least 88%; at least 89%; at least 90%; at least 91%; at least 92%; at least 93%; at least 94%; at least 95%; at least 96%; at least 97%; at least 98%; and at least 99%) identity to SEQ ID NO:1; SEQ ID NO:4; SEQ ID NO:7; and/or SEQ ID NO:14. In particular examples, a heterologous PUFA synthase system includes at least one protein comprising SEQ ID NO:1; SEQ ID NO:4; SEQ ID NO:7; and/or SEQ ID NO:14. In particular examples, a heterologous PUFA synthase system comprises at least one protein having an amino acid sequence selected from the group consisting of SEQ ID NO:1; SEQ ID NO:4; SEQ ID NO:7; and SEQ ID NO:14.

Some embodiments include a heterologous PUFA synthase system that comprises at least one functional equivalent of SEQ ID NO:1; SEQ ID NO:4; SEQ ID NO:7; and/or SEQ ID NO:14. For example, the system may comprise a variant, portion, fragment, or derivative of SEQ ID NO:1; SEQ ID NO:4; SEQ ID NO:7; and/or SEQ ID NO:14, wherein such a polypeptide has PUFA synthase activity. For example, the sequences of other PUFA synthase polypeptides (and genes encoding the same) can be identified in the literature and in bioinformatics databases available in the art. Such sequences may be identified, for example, through BLAST searching of publicly available databases with known PUFA synthase gene or polypeptide sequences. In such a method, identities can be based on the ClustalW method of alignment using the default parameters of GAP PENALTY=10, GAP LENGTH PENALTY=0.1, and Gonnet 250 series of protein weight matrix.

Additionally, the PUFA synthase gene or polypeptide sequences disclosed herein can be used to identify other PUFA synthase homologs in nature. For example, each of the PUFA synthase nucleic acid fragments disclosed herein can be used to isolate genes encoding homologous proteins. Isolation of homologous genes using sequence-dependent protocols is well known in the art. Examples of sequence-dependent protocols include, for example and without limitation: methods of nucleic acid hybridization; methods of DNA and RNA amplification, as exemplified by various uses of nucleic acid amplification technologies (e.g., polymerase chain reaction (PCR), ligase chain reaction (LCR), and strand displacement amplification (SDA); and methods of library construction and screening by complementation.

In some embodiments, a heterologous PUFA synthase comprises a *Schizochytrium* PUFA synthase domain (e.g., ER domains, ACP domains, KS domains, AT domains, KR domains, DH domains, CLF domains, MAT domains, and dehydratase conserved active site motifs), wherein the domain is combined with one or more domains from a different PUFA synthase to form a complete PUFA synthase having PUFA synthase activity.

In some embodiments, a genetically modified organism comprising a heterologous PUFA synthase can be further modified with at least one domain or biologically active fragment thereof of another PUFA synthase. In particular embodiments, any of the domains of a PUFA synthase may be modified from their natural structure to modify or enhance the function of that domain in the PUFA synthase system (e.g., to modify the PUFA types or ratios thereof produced by the system).

Phosphopantetheinyl Transferases

The phosphopantetheinyl transferases (PPTases) are a family of enzymes involved in fatty acid synthesis, polyketide synthesis, and non-ribosomal peptide synthesis. In particular, the ACP domains present in PUFA synthase enzymes require activation by attachment of a cofactor (4-phosphopantetheine) from coenzyme A to the acyl carrier protein (ACP). Attachment of this cofactor is carried out by PPTases. If the endogenous PPTases of the host organism are incapable of activating the PUFA synthase ACP domains, then it is necessary to provide a PPTase that is capable of carrying out that function.

One example of a PPTase, which has been demonstrated to recognize ACP domains as substrates, is the HetI protein of a *Nostoc* sp. HetI is present in a cluster of genes in *Nostoc* known to be responsible for the synthesis of certain fatty acids in that organism. Black and Wolk (1994) J. Bacteriol. 176:2282-92; Campbell et al. (1997) Arch. Microbiol. 167:251-8. HetI is likely to activate the ACP domains of a protein, HglE, present in that cluster.

In embodiments, a PUFA synthase system includes at least one PPTase or 4'-phosphopantetheinyl transferase domain as an accessory domain or protein to the PUFA synthase. Numerous examples of polypeptides having PPTase activity are known in the art and may be used in a genetically modified organism herein, if they are capable of activating the ACP domains of the particular PUFA synthase being used. Examples of polypeptides that may be included in such a heterologous PUFA synthase system include, for example and without limitation, at least one protein comprising an amino acid sequence having at least 80% (e.g., at least 81%; at least 82%; at least 83%; at least 84%; at least 85%; at least 86%; at least 87%; at least 88%; at least 89%; at least 90%; at least 91%; at least 92%; at least 93%; at least 94%; at least 95%; at least 96%; at least 97%; at least 98%; and at least 99%) identity to the polypeptide encoded by SEQ ID NO:10 (NoHetI protein). In particular examples, a heterologous PUFA synthase system includes the polypeptide encoded by SEQ ID NO:10.

Some embodiments include a heterologous PUFA synthase system that comprises a functional equivalent of the polypeptide encoded by SEQ ID NO:10. For example, the system may comprise a variant, portion, fragment, or derivative of the polypeptide encoded by SEQ ID NO:10, wherein such a polypeptide has phosphopantetheinyl transferase activity. For example, the sequences of other PPTases (and genes encoding the same) can be identified in the literature and in bioinformatics databases available in the art. Such sequences may be identified, for example, through BLAST searching of publicly available databases with known PPTase gene or polypeptide sequences. In such a method, identities can be based on the ClustalW method of alignment using the default parameters of GAP PENALTY=10, GAP LENGTH PENALTY=0.1, and Gonnet 250 series of protein weight matrix. The PPTase sequences disclosed herein can be used to identify other PPTase homologs in nature. For example, PPTase nucleic acids herein (e.g., SEQ ID NO:10) can be used to isolate genes encoding homologous proteins.

According to the foregoing, in some embodiments a genetically modified organism (e.g., a plant) and/or a descendant, cell, tissue, or part thereof comprises a heterologous PUFA synthase (e.g., a PUFA synthase from the Thraustochytrid *Schizochytrium* alga) and a heterologous PPTase (e.g., a NoHetI PPTase).

Acyl-CoA Synthetases

Acyl-CoA synthetase (ACS, or alternatively, ACoAS) proteins catalyze the conversion of long chain PUFA free fatty acids (FFAs) to acyl-CoA. Numerous examples of polypeptides having ACoAS activity are known in the art and may be used in embodiments herein. For example, *Schizochytrium* sp. ATCC Accession No. 20888 possesses one or more ACoASs that are capable of converting the free fatty acid products of its PUFA synthase into acyl-CoA, including the polypeptide encoded by SEQ ID NO:11 (SzACS2 protein).

In some embodiments, a heterologous PUFA synthase system includes, for example and without limitation, at least one protein comprising an amino acid sequence having at least 80% (e.g., at least 81%; at least 82%; at least 83%; at least 84%; at least 85%; at least 86%; at least 87%; at least 88%; at least 89%; at least 90%; at least 91%; at least 92%; at least 93%; at least 94%; at least 95%; at least 96%; at least 97%; at least 98%; and at least 99%) identity to the polypeptide encoded by SEQ ID NO:11. In particular examples, a heterologous PUFA synthase system includes the polypeptide encoded by SEQ ID NO:11.

Some embodiments include a heterologous PUFA synthase system that comprises a functional equivalent of the polypeptide encoded by SEQ ID NO:11. For example, the system may comprise a variant, portion, fragment, or derivative of the polypeptide encoded by SEQ ID NO:11, wherein such a polypeptide has acyl-CoA synthetase activity. For example, the sequences of other ACoAS (and genes encoding the same) can be identified in the literature and in bioinformatics databases available in the art. Such sequences may be identified, for example, through BLAST searching of publicly available databases with known ACoAS gene or polypeptide sequences. In such a method, identities can be based on the ClustalW method of alignment using the default parameters of GAP PENALTY=10, GAP LENGTH PENALTY=0.1, and Gonnet 250 series of protein weight matrix. The ACoAS sequences disclosed herein can be used to identify other ACoAS homologs in nature. For example, ACoAS nucleic acids herein (e.g., SEQ ID NO:11) can be used to isolate genes encoding homologous proteins.

According to the foregoing, in some embodiments a genetically modified organism (e.g., a plant) and/or a descendant, cell, tissue, or part thereof comprises a heterologous PUFA synthase (e.g., a PUFA synthase from the Thraustochytrid *Schizochytrium* sp.); a heterologous PPTase (e.g., a NoHetI PPTase); and a heterologous ACoAS (e.g., a *Schizochytrium* ACoAS from ATCC Accession No. 20888).

Functional equivalents include but are not limited to additions or substitutions of amino acid residues within the reference amino acid sequence (i.e., SEQ ID NO:1; SEQ ID NO:4; SEQ ID NO:7; the polypeptide encoded by SEQ ID NO:10; the polypeptide encoded by SEQ ID NO:11; or SEQ ID NO:14), but which result in a silent change, thus producing a functionally equivalent gene product. For example, conservative amino acid substitutions may be made on the basis of similarity in polarity, charge, solubility, hydrophobicity, hydrophilicity, and/or the amphipathic nature of the residues involved.

Site-directed mutations can be made to PUFA synthase, PPTase, and/or ACoAS (using random mutagenesis techniques well known to those skilled in the art) and the resulting mutant enzymes may be assayed to confirm expected activity. For example, SEQ ID NO:1; SEQ ID NO:4; SEQ ID NO:7; the polypeptide encoded by SEQ ID NO:10; the polypeptide encoded by SEQ ID NO:11; or SEQ ID NO:14 may be aligned with homologs and other related proteins, wherein identical amino acid residues and conserved residues are indicated. Conservative alterations at the variable positions can be engineered in order to produce a polypeptide that retains function; e.g., PUFA synthase activity, phosphopantetheinyl transferase activity, and acyl-CoA synthetase activity.

Embodiments herein effect expression of a heterologous PUFA synthase system, for example, by providing a transgenic organism (e.g., a plant) comprising one or more polynucleotides encoding at least one component of a heterologous PUFA synthase system.

In some embodiments, a heterologous polynucleotide encoding at least one component of a heterologous PUFA synthase system comprises at least one polynucleotide encoding a PUFA synthase from the Thraustochytrid *Schizochytrium* sp. For example, a heterologous polynucleotide of embodiments herein may encode, for example and without limitation, at least one protein comprising an amino acid sequence having at least 80% (e.g., at least 81%; at least 82%; at least 83%; at least 84%; at least 85%; at least 86%; at least 87%; at least 88%; at least 89%; at least 90%; at least 91%; at least 92%; at least 93%; at least 94%; at least 95%; at least 96%; at least 97%; at least 98%; at least 99%; and 100%) identity to SEQ ID NO:1; SEQ ID NO:4; SEQ ID NO:7; and/or SEQ ID NO:14.

In some examples, a polynucleotide encoding a PUFA synthase from the Thraustochytrid *Schizochytrium* sp. comprises a nucleotide sequence having at least 70% (e.g., at least 71%; at least 72%; at least 73%; at least 74%; at least 75%; at least 76%; at least 77%; at least 78%; at least 79%; at least 80%; at least 81%; at least 82%; at least 83%; at least 84%; at least 85%; at least 86%; at least 87%; at least 88%; at least 89%; at least 90%; at least 91%; at least 92%; at least 93%; at least 94%; at least 95%; at least 96%; at least 97%; at least 98%; at least 99%; and 100%) identity to SEQ ID NO:2; SEQ ID NO:3; SEQ ID NO:5; SEQ ID NO:6; SEQ ID NO:8; SEQ ID NO:9; and/or SEQ ID NO:13.

In particular examples, the heterologous polynucleotide encoding a PUFA synthase from the Thraustochytrid *Schizochytrium* sp. hybridizes under stringent conditions (e.g., very stringent conditions) to SEQ ID NO:2 and/or SEQ ID NO:3; SEQ ID NO:5 and/or SEQ ID NO:6; SEQ ID NO:8, SEQ ID NO:9, and/or SEQ ID NO:13.

In some embodiments, a heterologous polynucleotide encoding at least one component of a heterologous PUFA synthase system comprises a polynucleotide encoding a phosphopantetheinyl transferase (HetI) from the cyanobacteria genus, *Nostoc*. For example, a heterologous polynucleotide of embodiments herein may encode, for example and without limitation, at least one protein comprising an amino acid sequence having at least 80% (e.g., at least 81%; at least 82%; at least 83%; at least 84%; at least 85%; at least 86%; at least 87%; at least 88%; at least 89%; at least 90%; at least 91%; at least 92%; at least 93%; at least 94%; at least 95%; at least 96%; at least 97%; at least 98%; at least 99%; and 100%) identity to the polypeptide encoded by SEQ ID NO:10 (i.e., NoHetI).

In some examples, a polynucleotide encoding a phosphopantetheinyl transferase (HetI) from the cyanobacteria genus, *Nostoc* comprises a nucleotide sequence having at least 70% (e.g., at least 71%; at least 72%; at least 73%; at least 74%; at least 75%; at least 76%; at least 77%; at least 78%; at least 79%; at least 80%; at least 81%; at least 82%; at least 83%; at least 84%; at least 85%; at least 86%; at least 87%; at least 88%; at least 89%; at least 90%; at least 91%; at least 92%; at least 93%; at least 94%; at least 95%; at least 96%; at least 97%; at least 98%; at least 99%; and 100%) identity to SEQ ID NO:10.

In particular examples, the polynucleotide encoding a *Nostoc* phosphopantetheinyl transferase (NoHetI) hybridizes under stringent conditions (e.g., very stringent conditions) to SEQ ID NO:10.

In some embodiments, a heterologous polynucleotide encoding at least one component of a heterologous PUFA synthase system comprises a polynucleotide encoding an ACoAS from *Schizochytrium*. For example, a heterologous polynucleotide of embodiments herein may encode, for example and without limitation, at least one protein comprising an amino acid sequence having at least 80% (e.g., at least 81%; at least 82%; at least 83%; at least 84%; at least 85%; at least 86%; at least 87%; at least 88%; at least 89%; at least 90%; at least 91%; at least 92%; at least 93%; at least 94%; at least 95%; at least 96%; at least 97%; at least 98%; at least 99%; and 100%) identity to the polypeptide encoded by SEQ ID NO:11 (i.e., SzACS2).

In some examples, a polynucleotide encoding an heterologous ACoAS from *Schizochytrium* (e.g., ATCC Accession No. 20888) comprises a nucleotide sequence having at least 70% (e.g., at least 71%; at least 72%; at least 73%; at least 74%; at least 75%; at least 76%; at least 77%; at least 78%; at least 79%; at least 80%; at least 81%; at least 82%; at least 83%; at least 84%; at least 85%; at least 86%; at least 87%; at least 88%; at least 89%; at least 90%; at least 91%; at least 92%; at least 93%; at least 94%; at least 95%; at least 96%; at least 97%; at least 98%; at least 99%; and 100%) identity to SEQ ID NO:11.

In particular examples, the polynucleotide encoding the heterologous ACoAS hybridizes under stringent conditions (e.g., very stringent conditions) to SEQ ID NO:11.

In embodiments, one or more polynucleotides encoding at least one component of a heterologous PUFA synthase may include at least one polynucleotide encoding a PUFA synthase from the Thraustochytrid *Schizochytrium* sp., either with or without a polynucleotide encoding a phosphopantetheinyl transferase (HetI) from the cyanobacteria genus, *Nostoc* and/or a heterologous polynucleotide encoding an ACoAS from *Schizochytrium*. In some examples, the at least one polynucleotides encoding the foregoing components are present in a single nucleic acid molecule. In some examples, the at least one polynucleotides are present in multiple nucleic acid molecules.

Some embodiments include vectors (e.g., plasmids) comprising one or more polynucleotides encoding at least one component of a heterologous PUFA synthase. In examples, such vectors include regulatory sequences that are operably linked to the polynucleotides, so as to effect expression of the polynucleotides in a target host organism. Particular examples of such vectors include recombinant expression vectors, such as pDAB101429 (SEQ ID NO:15); pDAB101454 (SEQ ID NO:16); pDAB101496 (SEQ ID NO:17); pDAB109525 (SEQ ID NO:18); pDAB109584 (SEQ ID NO:19); pDAB109588 (SEQ ID NO:20); pDAB112210 (SEQ ID NO:21); pDAB112206 (SEQ ID NO:22); pDAB107962 (SEQ ID NO:23); pDAB109591 (SEQ ID NO:24); pDAB109592 (SEQ ID NO:25); pDAB107960 (SEQ ID NO:26); pDAB110132 (SEQ ID NO:27); pDAB107961 (SEQ ID NO:28); pDAB110151 (SEQ ID NO:29); pDAB112285 (SEQ ID NO:30); pDAB117501 (SEQ ID NO:31); pDAB117502 (SEQ ID NO:32); pDAB112200 (SEQ ID NO:33); pDAB112201 (SEQ ID NO:34); pDAB112203 (SEQ ID NO:35); pDAB112205 (SEQ ID NO:36); pDAB112208 (SEQ ID NO:37); and pDAB112209 (SEQ ID NO:38).

Known techniques in recombinant DNA technology may be used in certain embodiments to improve control of expression of heterologous polynucleotides, for example and without limitation, by manipulating the number of copies of the polynucleotides within the host cell; by manipulating the efficiency with which those polynucleotides are transcribed; by manipulating the efficiency with which the resultant transcripts are translated; and by manipulating the efficiency of post-translational modifications. By way of further example, promoter sequences may be genetically engineered to improve the level of expression in the host, as compared to the reference promoter. Thus, techniques useful for controlling the expression of nucleic acid molecules include, for example and without limitation, integration of the nucleic acid molecules into one or more host cell chromosomes; addition of vector stability sequences to plasmids; substitutions or modifications of transcription control signals (e.g., promoters, operators, and enhancers); substitutions or modifications of translational control signals (e.g., ribosome binding sites and Shine-Dalgarno sequences); modification of nucleic acid molecules to correspond to the codon usage of the host cell; and deletion of sequences that destabilize transcripts.

V. Methods of Making Genetically Modified Organisms

To produce significantly high yields of one or more desired polyunsaturated fatty acids, a host organism (e.g., a plant) can be genetically modified to introduce a heterologous PUFA synthase system into the organism. In some embodiments, this process is employed to produce a genetically modified plant that comprises the heterologous PUFA synthase system. Some examples also include methods to improve or enhance the effectiveness of such genetic modification, for example, to improve or enhance the production and/or accumulation of the end-product of a PUFA synthase system; e.g., LC-PUFAs, such as DHA and EPA. Particular embodiments herein result in the expression of one or more *Schizochytrium* PUFA synthases and PPTases, as described above, to increase PUFA production and/or accumulation in a heterologous host. Particular embodiments also result in the expression of an ACS in the host.

Methods for gene expression in a genetically modified organism, including, for example and without limitation, a plant, are known in the art. In some embodiments, the coding regions for the heterologous polynucleotides encoding a component of a PUFA synthase system to be expressed are codon-optimized for a target host cell. Expression of genes in recombinant host cells, including, for example and without limitation, plant cells, can require a promoter operably linked to a coding region of interest, and/or a transcriptional terminator. In some embodiments, a heterologous polynucleotides encoding a component of a PUFA synthase system is operably linked to a seed-specific promoter (e.g., PvDlec2, LfKCS3, FAE1, BoACP, and BnaNapinC). In some embodiments, heterologous polynucleotides encoding a component of a PUFA synthase system is operably linked to a leaf-specific promoter (e.g., ubiquitin and CsVMV). Other non-limiting examples of promoters that may be used in certain embodiments include the acyl carrier protein promoter (International Patent Publication No. WO 1992/18634) and the *Phaseolus vulgaris* beta-phaseolin promoter (and truncated versions). See, e.g., Slightom et al. (1983) Proc. Natl. Acad. Sci. U.S.A. 80:1897-1901; Sengupta-Gopalan et al. (1985) Proc. Nat. Acad. Sci. U.S.A. 82:3320-4; van der Geest et al. (1997) Plant Mol. Biol. 33:553-7; and Bustos et al. (1991) EMBO J. 10:1469-79.

Some embodiments include a recombinant vector (e.g., a plasmid) comprising one or more heterologous polynucleotides encoding a component of a PUFA synthase system. A recombinant vector is an engineered (e.g., artificially produced) nucleic acid molecule that is used as a tool for manipulating a nucleic acid sequence of choice, and/or for introducing such a nucleic acid sequence into a host cell. The recombinant vector may, therefore, be suitable for use in cloning, sequencing, and/or otherwise manipulating a polynucleotide therein, such as by expressing and/or delivering the polynucleotide into a host cell to form a recombinant cell. A vector may contain nucleotide sequences that are not naturally found adjacent to the polynucleotide to be cloned or delivered. A vector may also contain regulatory nucleic acid sequences (e.g., promoters, untranslated regions) that are naturally found adjacent to the polynucleotide or that are useful for expression of the polynucleotide. An integrated polynucleotide may be under chromosomal promoter control, under native or plasmid promoter control, or under a combination of several promoter controls. A vector may be either RNA or DNA, and may be either prokaryotic or eukaryotic. A vector may be maintained as an extrachromosomal element (e.g., a plasmid) or it may be integrated into a chromosome of a recombinant organism (e.g., a microbe, and plant cell). The entire vector may remain in place within a host cell, or under certain conditions, extraneous DNA (e.g., unnecessary plasmid sequences) may be deleted, leaving behind one or more heterologous polynucleotides encoding a component of a PUFA synthase system. Single or multiple copies of the heterologous polynucleotides may be integrated into the host genome. A recombinant vector of the present invention may contain at least one selectable marker.

In some embodiments, a recombinant vector comprising one or more heterologous polynucleotides encoding a component of a PUFA synthase system is an expression vector, for example, a plant expression vector. In such embodiments, at least one polynucleotide encoding the product to be produced (e.g., a *Schizochytrium* PUFA synthase, NoHetI, and SzACS2) may be inserted into the recombinant vector in a manner that operably links the polynucleotide(s) to regulatory sequences in the vector that enable the transcription and translation of the nucleic acid sequence within the recombinant host cell. Vectors useful for the transformation of a variety of host organisms and cells are known in the art. Typically, a vector contains a selectable marker, and sequences allowing autonomous replication or chromosomal integration in the desired host.

Suitable methods for transformation of host cells include any method by which DNA can be introduced into a cell, such as by transformation of protoplasts (See, e.g., U.S. Pat. No. 5,508,184), by desiccation/inhibition-mediated DNA uptake (See, e.g., Potrykus et al. (1985) Mol. Gen. Genet. 199:183-8), by electroporation (See, e.g., U.S. Pat. No. 5,384,253), by agitation with silicon carbide fibers (See, e.g., U.S. Pat. Nos. 5,302,523 and 5,464,765), by *Agrobacterium*-mediated transformation (See, e.g., U.S. Pat. Nos. 5,563,055; 5,591,616; 5,693,512; 5,824,877; 5,981,840; and 6,384,301), and by acceleration of DNA-coated particles (See, e.g., U.S. Pat. Nos. 5,015,580; 5,550,318; 5,538,880; 6,160,208; 6,399,861; and 6,403,865). Through the application of techniques such as these, the cells of virtually any species may be stably transformed, including both monocotyledonous and dicotyledonous plants. In some embodiments, transforming DNA is integrated into the genome of the host cell. In the case of multicellular species, transgenic cells may be regenerated into a transgenic organism. Any of these techniques may be used to produce a transgenic monocotyledonous or dicotyledonous plant, for example, comprising one or more heterologous polynucleotides encoding a component of a PUFA synthase system in the genome of the transgenic plant.

The most widely utilized method for introducing an expression vector into plants is based on the natural transformation system of *Agrobacterium*. *A. tumefaciens* and *A. rhizogenes* are plant pathogenic soil bacteria which genetically transform plant cells. The Ti and Ri plasmids of *A. tumefaciens* and *A. rhizogenes*, respectively, carry genes responsible for genetic transformation of the plant. The Ti (tumor-inducing)-plasmids contain a large segment, known as T-DNA, which is transferred to transformed plants. Another segment of the Ti plasmid, the vir region, is responsible for T-DNA transfer. The T-DNA region is bordered by terminal repeats. In modified binary vectors, the tumor-inducing genes have been deleted, and the functions of the vir region are utilized to transfer foreign DNA bordered by the T-DNA border sequences. The T-region may also contain a selectable marker for efficient recovery of transgenic plants and cells, and a multiple cloning site for inserting sequences for transfer such as a dsRNA encoding nucleic acid.

Thus, in some embodiments, a plant transformation vector is derived from a Ti plasmid of *A. tumefaciens* (See, e.g., U.S. Pat. Nos. 4,536,475, 4,693,977, 4,886,937, and 5,501,967; and European Patent EP 0 122 791) or a Ri plasmid of *A. rhizogenes*. Additional plant transformation vectors include, for example and without limitation, those described by Herrera-Estrella et al. (1983) Nature 303:209-13; Bevan et al. (1983) Nature 304:184-7; Klee et al. (1985) Bio/Technol. 3:637-42; and in European Patent EP 0 120 516, and those derived from any of the foregoing. Other bacteria such as *Sinorhizobium*, *Rhizobium*, and *Mesorhizobium* that interact with plants naturally can be modified to mediate gene transfer to a number of diverse plants. These plant-associated symbiotic bacteria can be made competent for gene transfer by acquisition of both a disarmed Ti plasmid and a suitable binary vector.

After providing exogenous DNA to recipient cells, transformed cells are generally identified for further culturing and plant regeneration. In order to improve the ability to identify transformed cells, one may desire to employ a selectable or screenable marker gene, as previously set forth, with the transformation vector used to generate the transformant. In the case where a selectable marker is used, transformed cells are identified within the potentially transformed cell population by exposing the cells to a selective agent or agents. In the case where a screenable marker is used, cells may be screened for the desired marker gene trait.

Cells that survive the exposure to the selective agent, or cells that have been scored positive in a screening assay, may be cultured in media that supports regeneration of plants. In some embodiments, any suitable plant tissue culture media (e.g., MS and N6 media) may be modified by including further substances, such as growth regulators. Tissue may be maintained on a basic media with growth regulators until sufficient tissue is available to begin plant regeneration efforts, or following repeated rounds of manual selection, until the morphology of the tissue is suitable for regeneration (e.g., at least 2 weeks), then transferred to media conducive to shoot formation. Cultures are transferred periodically until sufficient shoot formation has occurred. Once shoots are formed, they are transferred to media conducive to root formation. Once sufficient roots are formed, plants can be transferred to soil for further growth and maturity.

To confirm the presence of a nucleic acid molecule of interest (for example, a heterologous polynucleotide encoding a component of a PUFA synthase system) in the regenerating plants, a variety of assays may be performed. Such assays include, for example: molecular biological assays, such as Southern and Northern blotting, PCR, and nucleic acid sequencing; biochemical assays, such as detecting the presence of a protein product, e.g., by immunological means (ELISA and/or Western blots) or by enzymatic function; plant part assays, such as leaf or root assays; and analysis of the phenotype of the whole regenerated plant.

Integration events may be analyzed, for example, by PCR amplification using, e.g., oligonucleotide primers specific for a nucleic acid molecule of interest. PCR genotyping is understood to include, but not be limited to, polymerase-chain reaction (PCR) amplification of genomic DNA derived from isolated host plant callus tissue predicted to contain a nucleic acid molecule of interest integrated into the genome, followed by standard cloning and sequence analysis of PCR amplification products. Methods of PCR genotyping have been well described (for example, Rios, G. et al. (2002) Plant J. 32:243-53) and may be applied to genomic DNA derived from any plant species (e.g., Z. mays or G. max) or tissue type, including cell cultures.

A transgenic plant formed using Agrobacterium-dependent transformation methods typically contains a single recombinant DNA sequence inserted into one chromosome. The single recombinant DNA sequence is referred to as a "transgenic event" or "integration event." Such transgenic plants are heterozygous for the inserted exogenous sequence. In some embodiments, a transgenic plant homozygous with respect to a transgene may be obtained by sexually mating (selfing) an independent segregant transgenic plant that contains a single exogenous gene sequence to itself, for example, an $T_0$ plant, to produce $T_1$ seed. One fourth of the $T_1$ seed produced will be homozygous with respect to the transgene. Germinating $T_1$ seed results in plants that can be tested for heterozygosity, typically using a SNP assay or a thermal amplification assay that allows for the distinction between heterozygotes and homozygotes (i.e., a zygosity assay).

In addition to direct transformation of a plant with a recombinant nucleic acid molecule, transgenic plants can be prepared by crossing a first plant having at least one transgenic event with a second plant lacking such an event. For example, a recombinant nucleic acid molecule comprising one or more heterologous polynucleotide(s) encoding a component of a PUFA synthase system may be introduced into a first plant line that is amenable to transformation to produce a transgenic plant, which transgenic plant may be crossed with a second plant line to introgress the polynucleotide(s) into the second plant line.

Some embodiments include the targeting of expression of the heterologous PUFA synthase system polypeptides to one or more organelles of the host. For example, in some embodiments, expression of the heterologous PUFA synthase system is targeted to the plastid of a plant. Varieties of plastid targeting sequences are known in the art and can be used in embodiments where the heterologous host is a plant or plant cell, and wherein targeting to the plastid is desired. In some embodiments, expression of the heterologous PUFA synthase system is targeted to the cytosol. In some embodiments, acyl-CoA synthetases (ACoAS) are expressed in the cytosol to convert LC-PUFA free fatty acids to acyl-CoAs, which in turn can be utilized by the acyltransferases. In some embodiments, expression of the heterologous PUFA synthase system is targeted to both the plastid and the cytosol of a plant.

Particular embodiments include the use of organelle targeting (e.g., to the plastid or chloroplast in plants) of at least one Schizochytrium PUFA synthase with a NoHetI PPTase. The targeting of gene products to the plastid or chloroplast is controlled by a signal sequence found at the amino terminal end of various proteins, which is cleaved during import yielding the mature protein. See, e.g., Comai et al. (1988) J. Biol. Chem. 263:15104-9. These signal sequences can be fused to heterologous gene products to effect the import of heterologous products into the chloroplast. van den Broeck et al. (1985) Nature 313:358-63. DNA encoding appropriate signal sequences can be isolated, for example, from cDNAs encoding the RUBISCO protein, the CAB protein, the EPSP synthase enzyme, the GS2 protein, and many other proteins that are known to be chloroplast localized.

An alternative means for localizing genes to chloroplasts or plastids utilized in particular embodiments include chloroplast or plastid transformation. Recombinant plants can be produced in which only the chloroplast DNA has been altered to incorporate heterologous PUFA synthase system polypeptides. Promoters which function in chloroplasts are known in the art. Hanley-Bowden et al. (1987) Trends in Biochem. Sci. 12:67-70. Methods and compositions for obtaining cells containing chloroplasts into which heterologous DNA has been inserted are described, for example, in U.S. Pat. Nos. 5,693,507 and 5,451,513.

The foregoing genetic manipulations of a recombinant host can be performed using standard genetic techniques and screening, and can be made in any host cell that is suitable to genetic manipulation. In some embodiments, the recombinant host is a higher plant, including both dicotyledonous and monocotyledonous plants, and consumable plants, including crop plants and plants used for their oils. Thus, any plant species or plant cell can be selected as described further below.

VI. Transgenic Plants

Any plant or plant cell expressing a heterologous PUFA synthase system, for example, a functional heterologous protein system comprising a PUFA synthase and at least one accessory protein thereof is included in particular embodiments herein. Particular embodiments include a plant cell comprising a heterologous polynucleotide encoding a *Schizochytrium* PUFA synthase and a polynucleotide encoding a NoHetI PPTase, which plant cell may also comprise a polynucleotide encoding a *Schizochytrium* ACoAS. In some examples, such a transgenic plant has been further genetically modified to express a further polypeptide (e.g., ACoAS, GPAT, LPAAT, DAGAT, and acetyl CoA carboxylase (ACCase)) for the improvement of the production and/or accumulation of PUFAs or other bioactive products of the PUFA synthase by the host.

In some embodiments, a genetically modified plant (and/or plant cell thereof) is, for example and without limitation, selected from the group consisting of: higher plants; dicotyledonous plants; monocotyledonous plants; consumable plants (e.g., crop plants and plants used for their oils); soybean; rapeseed; linseed; corn; safflowers; sunflowers; tobacco; a plant of the family Fabaceae (Leguminosae, legume family, pea family, bean family, or pulse family); a plant of the genus *Glycine* (e.g., *G. albicans*, *G. aphyonota*, *G. arenari*, *G. argyrea*, *G. canescens*, *G. clandestine*, *G. curvata*, *G. cyrtoloba*, *G. falcate*, *G. gracei*, *G. hirticaulis*, *G. hirticaulis* subsp. *leptosa*, *G. lactovirens*, *G. latifolia*, *G. latrobeana*, *G. microphylla*, *G. montis-douglas*, *G. peratosa*, *G. pescadrensis*, *G. pindanica*, *G. pullenii*, *G. rubiginosa*, *G. stenophita*, *G. syndetika*, *G. tabacina*, *G. tomentella*, *G. soja*, and *G. max* (soybean)); peanut; *Phaseolus vulgaris*, *Vicia faba*; and *Pisum sativum*.

In some embodiments, a genetically modified plant is a plant that is known to produce compounds used as pharmaceutical agents, flavoring agents, nutraceutical agents, functional food ingredients or cosmetically active agents, or a plant that is genetically engineered to produce these compounds/agents.

In some embodiments, the genetically modified plant is an oilseed plant, wherein the oilseeds, and/or the oil therefrom, contain LC-PUFAs produced by the heterologous PUFA synthase system. In particular embodiments, such oils contain a detectable amount of at least one target or primary LC-PUFA that is the product of the PUFA synthase (e.g., DHA and EPA). In some embodiments, such oils can be substantially free of intermediate or side products that are not the target or primary PUFA products, and that are not naturally produced by the endogenous FAS system in the wild-type plants (e.g., wild-type plants produce some shorter or medium chain PUFAs, such as 18 carbon PUFAs, via the FAS system, but there will be new, or additional, fatty acids produced in the plant as a result of genetic modification with the heterologous PUFA synthase).

In some embodiments, a transgenic plant or seed expressing a heterologous PUFA synthase system described herein also may comprise at least one other transgenic event in its genome, including without limitation: a gene encoding an insecticidal protein (e.g., an *Bacillus thuringiensis* insecticidal protein); an herbicide tolerance gene (e.g., a gene providing tolerance to glyphosate); and a gene contributing to a desirable phenotype in the transgenic plant, such as increased yield, altered fatty acid metabolism, or restoration of cytoplasmic male sterility. In particular embodiments, polynucleotides encoding at least one *Schizochytrium* PUFA synthase are combined with such additional transgenes, either by recombinant DNA techniques or conventional breeding with a plant already comprising the additional transgene(s).

Also included in some embodiments are parts of a plant expressing a heterologous PUFA synthase system as described herein. Such plant parts include any parts of a plant, including, for example and without limitation, seeds (including mature seeds and immature seeds); tissues; pollen; embryos; flowers; fruits; shoots; leaves; roots; stems; and explants. Particular embodiments include descendants of a plant expressing a heterologous PUFA synthase system as described herein.

VII. Commodity Products

Embodiments herein include products produced by or from the plants, descendants, plant parts, or cells described herein, including, for example and without limitation, oils produced therefrom. Thus, some embodiments include commodity products containing one or more of the polypeptides and/or polynucleotides of the heterologous PUFA synthase system described herein, which commodity products are produced from a recombinant plant or seed expressing the heterologous PUFA synthase system. A commodity product containing one or more of the polypeptides and/or polynucleotides of the heterologous PUFA synthase system described herein includes, for example and without limitation: meals; oils; crushed or whole grains or seeds; and any food product comprising meal; oil; or crushed or whole grain of a recombinant plant or seed containing one or more of the polypeptides and/or polynucleotides. The detection of the polypeptides and/or polynucleotides of the heterologous PUFA synthase systems described herein in one or more plant commodity or plant commodity products contemplated herein is de facto evidence that the commodity or commodity product is composed of a transgenic plant expressing the heterologous PUFA synthase system. For example, the detection of polypeptides and/or polynucleotides of the heterologous PUFA synthase systems described herein as a contaminant in an oil is de facto evidence that the oil was produced from a transgenic plant expressing the heterologous PUFA synthase system.

Embodiments herein make possible for the production of commercially valuable lipids enriched in one or more desired (target or primary) PUFAs by the development of genetically modified plants through the use of a heterologous PUFA synthase system that produces PUFAs that are otherwise not produced by the plant species. In some embodiments, a genetically modified organism of the invention produces one or more polyunsaturated fatty acids including, but not limited to, EPA (C20:5, n-3), DHA (C22:6, n-3), DPA (C22:5, n-6 or n-3), and any combination thereof. Some embodiments herein specifically include oilseed and oils obtained from the genetically modified plants described herein comprising these PUFAs.

Plants are not known to endogenously contain a PUFA synthase and, therefore, embodiments herein provide an opportunity to produce plants with unique fatty acid production capabilities. Some embodiments offer the ability to create any one of a number of "designer oils," comprising novel combinations of fatty acids from plants in various ratios and forms. In some embodiments, the use of a heterologous PUFA synthase system described herein can extend the range of PUFA production, and successfully produce such PUFAs within temperature ranges used to grow most crop plants.

In some embodiments, a plant commodity product is "substantially free" of intermediate or side products of the system for synthesizing PUFAs. As used herein in this context, the term "substantially free" means that any intermediate or side product fatty acids (non-target PUFAs) that are produced in the genetically modified plant (and/or parts of plants and/or seed oil fraction) as a result of the introduction or presence of the heterologous PUFA system (e.g., that are not produced by the wild-type plant or the parent plant used as a recipient for the indicated genetic modification), are present in a quantity that is, for example and without limitation: less than 10% by weight of total fatty acids; less than 9% by weight of total fatty acids; less than 8% by weight of total fatty acids; less than 7% by weight of total fatty acids; less than 6% by weight of total fatty acids; less than 5% by weight of total fatty acids; less than 4% by weight of total fatty acids; less than 3% by weight of total fatty acids; less than 2% by weight of total fatty acids; less than 1% by weight of total fatty acids; and less than 0.5% by weight of total fatty acids.

In some embodiments, a genetically modified plant, descendant, cell, tissue, or part thereof that expresses a heterologous PUFA synthase system, or an oil or seed obtained from the genetically modified plant, descendant, cell, tissue, or part thereof, comprises a detectable amount of DHA (docosahexaenoic acid (C22:6, n-3)), DPA(n-6) (docosapentaenoic acid (C22:5 n-6)), and/or EPA (eicosapentaenoic acid (C20:5, n-3)).

In particular embodiments, a genetically modified plant, descendant, cell, tissue, or part thereof that expresses a heterologous PUFA synthase system, or an oil or seed obtained from the genetically modified plant, descendant, cell, tissue, or part thereof, comprises, for example and without limitation; at least 0.01%, at least 0.02%, at least 0.03%, at least 0.04%, at least 0.05%, at least 0.06%, at least 0.07%, at least 0.08%, at least 0.09%, at least 0.1%, at least 0.2%, at least 0.3%, at least 0.4%, at least 0.5%, at least 0.6%, at least 0.7%, at least 0.8%, at least 0.9%, at least 1%, at least 1.5%, at least 2%, at least 2.5%, at least 3%, at least 3.5%, at least 4%, at least 4.5%, at least 5%, at least 5.5%, at least 6%, at least 6.5%, at least 7%, at least 7.5%, at least 8%, at least 8.5%, at least 9%, at least 9.5%, at least 10%, at least 10.5%, at least 11%, at least 11.5%, at least 12%, at least 12.5%, at least 13%, at least 13.5%, at least 14%, at least 14.5% or at least 15% DHA by weight of total fatty acids. Useful ranges can be selected between any of these values, for example, 0.01% to 15%, 0.05% to 10% and 1% to 5% DHA by weight of total fatty acids.

In particular embodiments, a genetically modified plant, descendant, cell, tissue, or part thereof that expresses a heterologous PUFA synthase system, or an oil or seed obtained from the genetically modified plant, descendant, cell, tissue, or part thereof, comprises, for example and without limitation; at least 0.01%, at least 0.02%, at least 0.03%, at least 0.04%, at least 0.05%, at least 0.06%, at least 0.07%, at least 0.08%, at least 0.09%, at least 0.1%, at least 0.2%, at least 0.3%, at least 0.4%, at least 0.5%, at least 0.6%, at least 0.7%, at least 0.8%, at least 0.9%, at least 1%, at least 1.5%, at least 2%, at least 2.5%, at least 3%, at least 3.5%, at least 4%, at least 4.5%, at least 5%, at least 5.5%, at least 6%, at least 6.5%, at least 7%, at least 7.5%, at least 8%, at least 8.5%, at least 9%, at least 9.5%, and/or at least 10% EPA by weight of total fatty acids. Useful ranges can be selected between any of these values, for example, 0.01% to 10%, 0.05% to 5% and 0.1% to 5% EPA by weight of total fatty acids.

In particular embodiments, a genetically modified plant, descendant, cell, tissue, or part thereof that expresses a heterologous PUFA synthase system, or an oil or seed obtained from the genetically modified plant, descendant, cell, tissue, or part thereof, comprises, for example and without limitation; at least 0.01%, at least 0.02%, at least 0.03%, at least 0.04%, at least 0.05%, at least 0.06%, at least 0.07%, at least 0.08%, at least 0.09%, at least 0.1%, at least 0.2%, at least 0.3%, at least 0.4%, at least 0.5%, at least 0.6%, at least 0.7%, at least 0.8%, at least 0.9%, at least 1%, at least 1.5%, at least 2%, at least 2.5%, at least 3%, at least 3.5%, at least 4%, at least 4.5%, at least 5%, at least 5.5%, at least 6%, at least 6.5%, at least 7%, at least 7.5%, at least 8%, at least 8.5%, at least 9%, at least 9.5%, and/or at least 10% DPA(n-6) by weight of total fatty acids. Useful ranges can be selected between any of these values, for example, 0.01% to 10%, 0.01% to 5%, 0.01% to 1%, 0.01% to 0.05%, 0.05% to 5% and 0.1% to 5% DPA(n-6) by weight of total fatty acids.

The percentage amount of PUFA is the percentage by weight of total fatty acids extracted, unless otherwise stated. In some embodiments, total fatty acids are determined by gas chromatography (GC) analysis of a fatty acid methyl ester (FAME) preparation, although determination of total fatty acids is not limited to this method.

In particular embodiments, a genetically modified plant, descendant, cell, tissue, or part thereof that expresses a heterologous PUFA synthase system, or an oil or seed obtained from the genetically modified plant, descendant, cell, tissue, or part thereof, comprises a ratio of EPA:DHA of, for example and without limitation; at least 10:1, at least 9.5:1, at least 9:1, at least 8.5:1, at least 8:1, at least 7.5:1, at least 7:1, at least 6.5:1, at least 6:1, at least 5.5:1, at least 5:1, at least 4.5:1, at least 4:1, at least 3.5:1, at least 3:1, at least 2.5:1, at least 2:1, at least 1.5:1, at least 1:1, at least 1:1.5, at least 1:2, at least 1:2.5, at least 1:3, at least 1:3.5, at least 1:4, at least 1:4.5, at least 1:5, at least 1:5.5, at least 1:6, at least 1:6.5, at least 1:7, at least 1:7.5, at least 1:8, at least 1:8.5, at least 1:9, at least 1:10, at least 1:11, at least 1:12, at least 1:13, at least 1:14, at least 1:15, at least 1:16, at least 1:17, at least 1:18, at least 1:19, at least 1:20, at least 1:21, at least 1:22, at least 1:23, at least 1:24, at least 1:25, at least 1:26, at least 1:27, at least 1:28, at least 1:29, or at least 1:30 by weight of total fatty acids. Useful ranges can be selected between any of these values, for example, a ratio of EPA:DHA of 10:1, 5:1 to 1:1, 2:1 to 1:1, 1 to 1:30, 1:1 to 1:25, 1:1 to 1:20, 1:1 to 1:15, 1:1 to 1:10, 1:1 to 1:5, 1:1 to 1:3, and 1:1 to 1:2 by weight of total fatty acids.

In particular embodiments, a genetically modified plant, descendant, cell, tissue, or part thereof that expresses a heterologous PUFA synthase system, or an oil or seed obtained from the genetically modified plant, descendant, cell, tissue, or part thereof, comprises a ratio of DPA(n-6):DHA of, for example and without limitation; at least 1:1, at least 1:1.5, at least 1:2, at least 1:2.5, at least 1:3, at least 1:3.5, at least 1:4, at least 1:4.5, at least 1:5, at least 1:5.5, at least 1:6, at least 1:6.5, at least 1:7, at least 1:7.5, at least 1:8, at least 1:8.5, at least 1:9, or at least 1:10 by weight of total fatty acids. Useful ranges can be selected between any of these values, for example, a ratio of DPA(n-6):DHA of 1:1 to 1:10, 1:1 to 1:5, 1:1 to 1:3 and 1:1 to 1:2 by weight of total fatty acids.

In particular embodiments, a genetically modified plant, descendant, cell, tissue, or part thereof that expresses a heterologous PUFA synthase system, or an oil or seed obtained from the genetically modified plant, descendant, cell, tissue, or part thereof, comprises, for example and without limitation, at least 70%, at least 75%, at least 80%, at least 85%, at least 90%, at least 95%, or at least 99% triglycerides by weight of the oil. In some embodiments, an oil obtained from a genetically modified plant, descendant, cell, tissue, or part thereof or seed of the invention comprises from 70% to 99% triglycerides by weight of the oil, from 75% to 99% triglycerides by weight of the oil, from 80% to 99% triglycerides by weight of the oil, from 85% to 99% triglycerides by weight of the oil, or from 90% to 99% triglycerides by weight of the oil. Such triglycerides may incorporate LC-PUFAs that are produced by the heterologous PUFA synthase system.

In particular embodiments, when the target product of a heterologous PUFA synthase system is a LC-PUFA, such as DHA, DPA (n-6 or n-3), or EPA, intermediate products and side products that are not present in substantial amounts in the total lipids of the genetically modified plant expressing the system include, for example and without limitation: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9), and various other intermediate or side products, such as 20:0; 20:1 (Δ5); 20:1 (Δ11); 20:2 (Δ8,11); 20:2 (Δ11,14); 20:3 (Δ5,11,14); 20:3 (Δ11,14,17); mead acid (20:3; 45,8,11); or 20:4 (Δ5,1,14,17).

In some embodiments, PUFAs produced by a heterologous PUFA synthase system are recovered from a genetically modified plant expressing the system through purification processes that extract the compounds from the plant, descendant, cell, tissue, or part thereof. In some embodiments, the PUFAs are recovered by harvesting the plant, descendant, cell, tissue, or part thereof. In some embodiments, the PUFAs are recovered by harvesting the oil from the plant, descendant, cell, tissue, or part thereof (e.g., from the oil seeds). In some embodiments, the plant, descendant, cell, tissue, or part thereof is consumed in its natural state, or is further processed into consumable products.

In some embodiments herein, the oils from a genetically modified plant expressing a heterologous PUFA synthase system may be used in non-culinary or non-dietary processes and compositions. Some of these uses are industrial, cosmetic, or medical (e.g., the oils can be used in a protective barrier against infection and to enhance transplant graft survival (U.S. Pat. No. 6,210,700)). Oils from a genetically modified plant expressing a heterologous PUFA synthase system can also be used in any application for which the oils of the present invention are suited. In general, the oils can be used to replace, e.g., mineral oils, esters, fatty acids, or animal fats in a variety of applications, such as lubricants, lubricant additives, metal working fluids, hydraulic fluids and fire resistant hydraulic fluids. The oils can also be used as materials in a process of producing modified oils. Examples of techniques for modifying oils include fractionation, hydrogenation, alteration of the oil's oleic acid or linolenic acid content, and other modification techniques known to those of skill in the art.

Examples of cosmetic uses for oils from a genetically modified plant expressing a heterologous PUFA synthase system include use as an emollient in a cosmetic composition; as a petroleum jelly replacement; as comprising part of a soap, as a material in a process for producing soap; as comprising part of an oral treatment solution; as comprising part of an ageing treatment composition; and as comprising part of a skin or hair aerosol foam preparation.

The following examples are provided to illustrate certain particular features and/or embodiments. The examples should not be construed to limit the disclosure to the particular features or embodiments exemplified.

EXAMPLES

Example 1: Materials and Methods

Unless otherwise indicated, molecular biological and biochemical manipulations described in the subsequent Examples were performed by standard methodologies as disclosed in, for example, Ausubel et al. (1995) *Current Protocols in Molecular Biology*, John Wiley & Sons; Sambrook et al. (1989) *Molecular Cloning: A Laboratory Manual*, Cold Spring Harbor Laboratory Press; and the like.

Plant-Optimized Polynucleotides.

Multiple DNA sequences having a canola codon bias were designed and synthesized to produce PUFA synthase enzymes in transgenic plants. A codon usage table for canola (*Brassica napus* L.) was calculated from protein coding sequences obtained from sequences deposited in GenBank (available on the internet at ncbi.nlm.nih.gov). A Rescaled canola codon set was calculated after omitting any synonymous codon used less than about 10% of total codon uses for that amino acid. The Rescaled representation for each codon was calculated using the formula:

$$\text{Rescaled \% of } C1 = 1/(\% \ C1 + \% \ C2 + \% \ C3 \ldots) \times \% \ C1 \times 100,$$

where C1 is the codon in question and % C1, % C2, and % C3 . . . represent the original % usage values of the remaining synonymous codons.

To derive a canola-codon-optimized DNA sequence encoding the amino acid PFA1 protein of SEQ ID NO:1, PFA2 protein of SEQ ID NO:4, and PFA3 protein of SEQ ID NO:7, codon substitutions to the experimentally determined (native) PFA1 DNA sequence (SEQ ID NO:2), PFA2 DNA sequence (SEQ ID NO:5), and PFA3 DNA sequence (SEQ ID NO:8) were made such that the resulting DNA sequences had the overall codon composition of the canola-optimized codon bias table.

Further refinements of the sequences were made to eliminate undesirable restriction enzyme recognition sites, potential plant intron splice sites, long runs of A/T or C/G residues, and other motifs that might interfere with mRNA stability, transcription, or translation of the coding region in plant cells. Other changes were made to introduce desired restriction enzyme recognition sites, and to eliminate long internal Open Reading Frames (frames other than +1). These changes were all made within the constraints of retaining the canola-biased rescaled codon composition. Polynucleotides comprising the resulting nucleotide canola codon-optimized DNA sequences were synthesized. Table 1.

TABLE 1

Codon-optimized sequences

| Gene | Polypeptide sequence | Native DNA sequence | Codon-optimized sequence |
|---|---|---|---|
| PFA1 | SEQ ID NO: 1 | SEQ ID NO: 2, PFA1v1 | SEQ ID NO: 3, PFA1v2 |
| PFA2 | SEQ ID NO: 4 | SEQ ID NO: 5, PFA2v1 | SEQ ID NO: 6, PFA2v2 |
| PFA3 | SEQ ID NO: 7 | SEQ ID NO: 8, PFA3v1 | SEQ ID NO: 9, PFA3v2 |

Lipid Extraction and Analysis.

Segregating seeds were analyzed via a FAME analysis method to identify transgenic plant events (obtained from soybean, canola, and *Arabidopsis*) which comprised LC-PUFAs as compared to control plants grown in the same conditions. The LC-PUFA content (% FAMEs by weight) were quantitated and compared to a negative control plant. The FAME analysis was completed on single seeds or performed on bulked seeds from each individual transgenic event that were assayed using the protocol described below.

*Arabidopsis* and canola seed analysis. Transgenic seed samples (either canola single seeds or bulked *Arabidopsis* seed samples) were homogenized in heptane containing triheptadecanoin (Nu-Chek™ Prep, Elysian, Minn.) as a triacylglycerol internal standard, using a steel ball mill. Prior to homogenization, a solution of 0.25 M freshly-prepared sodium methoxide (Sigma-Aldrich, St. Louis, Mo.) in methanol was added. Extraction and derivation were conducted at 40° C. with constant shaking. FAME extraction was repeated three times and the heptane layers were pooled prior to analysis. Bulked *Arabidopsis* and canola seed analysis consisted of a 10 mg aliquot for *Arabidopsis* or 8-12 canola seeds, respectively. In order to drive the derivatization reaction to completeness, the oil from bulk seed canola and soybean single seed was first extracted three times with heptane. Then, an aliquot of the combined oil extract was derivatized in FAMEs. The completeness of the reaction was verified by checking for the presence of endogenous FAMEs in a fourth extraction/derivatization. The resulting FAMEs were analyzed by GC-FID using an Agilent 6890 Gas Chromatograph (Agilent Technologies, Santa Clara, Calif.) and a capillary column BPX 70™ (15 m×0.25 mm×0.25 µm) from SGE (Austin, Tex.). Each FAME was identified by retention time and quantified by the injection of a rapeseed oil reference mix from Matreya LLC (Pleasant Gap, Pa.) as a calibration standard with addition of appropriate long chain fatty acids (Nu-Chek Prep, Elysian Minn.). The results of the production of DHA and other LC-PUFAs in *Arabidopsis*, soybean, and canola are described below.

Example 2: Expression of PUFA Synthase Genes in Plants

Binary vectors were constructed that contained plant transcription units (PTUs) comprising the native and codon-optimized PUFA synthase system transgenes (PFA1, PFA2, and PFA3) operably linked to a promoter and 3'-UTR. The resulting binary vectors also contained a PTU comprising the HetI transgene operably linked to a promoter and 3' UTR. Only one binary vector included the SzACS2 transgene operably linked to a promoter and 3' UTR (pDAB101429). Different promoter and 3'-UTR sequence combinations were incorporated in the binary vectors to drive expression of the PUFA synthase system and HetI transgenes. Use of these different regulatory gene elements was incorporated into the design of the PTUs to alter and vary the expression levels of the transgene. Likewise, the PTUs were positioned within the binary vector in different orientations to test whether the orientation of the PTUs altered or varied the expression levels of the transgenes.

Three different orientations of PTUs were tested. The binary vectors comprising PTUs arranged in the first orientation were situated in a head to tail configuration.

The binary vectors comprising PTUs arranged in the second orientation were constructed to utilize the bi-directionality of the 3' UTRs. The PFA1 and HetI PTUs shared a single 3' UTR, and were oriented in the following configuration; promoter::gene of interest::3'UTR gene of interest:: promoter. Likewise, the PFA3 and PFA2 PTUs shared a single 3' UTR, and were oriented in the following configuration; promoter::gene of interest::3'UTR::gene of interest:: promoter.

Finally, the third orientation incorporated a random DNA spacer sequence (SEQ ID NO:12). The random DNA spacer is positioned between two PTUs oriented upstream of the random DNA spacer, and two PTUs oriented downstream of the random DNA spacer. Both sets of PTUs are constructed in a head to head orientation. Accordingly, the orientation is as follows; ←PFA1 PTU HetI PTU→::random DNA spacer::←PFA3 PTU PFA 2 PTU→.

First Orientation pDAB101429.

The pDAB101429 plasmid (SEQ ID NO:15) contains three PUFA synthase PTUs, one acyl-CoA synthetase PTU, one phosphopantetheinyl transferase PTU, and a phosphinothricin acetyl transferase PTU. Specifically, the first PUFA synthase PTU contains a truncated *Phaseolus vulgaris* phytohemagglutinin-L gene promoter (PvDlec2 promoter v2; GenBank Accession Number X06336), *Arabidopsis thaliana* AT2S3 gene 5' untranslated region (2S 5' UTR; GenBank Accession Number NM_118850), *Schizochytrium* sp. PolyUnsaturated Fatty Acid synthase PFA1 v2 and *Arabidopsis thaliana* 2S albumin gene 3' untranslated region terminator v1 (At2S SSP terminator v1; GenBank Accession Number M22035). The second PUFA synthase PTU contains the PvDlec2 promoter v2, 2S 5' UTR, *Schizochytrium* sp. PolyUnsaturated Fatty Acid synthase PFA2 v2, and At2S SSP terminator v1. The third PUFA synthase PTU contains the PvDlec2 promoter v2, 2S 5' UTR, *Schizochytrium* sp. PolyUnsaturated Fatty Acid synthase PFA3 v2 and At2S SSP terminator v1. The acyl-CoA synthetase PTU contains the PvDlec2 promoter v2, 2S 5' UTR, *Schizochytrium* sp. acyl-CoA synthetase (SzACS-2 v3) and At2S SSP terminator v1. The phosphopantetheinyl transferase PTU contains the PvDlec2 promoter v2, 2S 5' UTR, *Nostoc* sp. 4' phosphopantetheinyl transferase HetI (NoHetI v3) and At2S SSP terminator v1. These five PTUs were placed in a head-to-tail orientation within the T-strand DNA border regions of a plant transformation binary vector (pDAB7333). The order of the genes is: PFA1 v2, PFA2 v2, PFA3 v2, SzACS-2 v3, NoHetI v3. The plant transformation binary vector also contains the phosphinothricin acetyl transferase PTU: Cassava vein Mosaic Virus Promoter (CsVMV promoter v2; Verdaguer et al., Plant Molecular Biology 31:1129-1139;

1996), phosphinothricin acetyl transferase (PAT v5; Wohlleben et al., Gene 70:25-37; 1988) and *Agrobacterium tumefaciens* ORF1 3' untranslated region (AtuORF1 3' UTR v4; Huang et al., J. Bacteriol. 172:1814-1822; 1990), in addition to other regulatory elements such as Overdrive (Toro et al., PNAS 85(22): 8558-8562; 1988) and T-stand border sequences (T-DNA Border A and T-DNA Border B; Gardner et al., Science 231:725-727; 1986 and International Publication No. WO 2001/025459 A1). Recombinant plasmids were isolated and tested for incorporation of the PTUs with restriction enzyme digestion and DNA sequencing.

pDAB101454.

The pDAB101454 plasmid (SEQ ID NO:16) contains three PUFA synthase PTUs, one phosphopantetheinyl transferase PTU, and a phosphinothricin acetyl transferase PTU. Specifically, the first PUFA synthase PTU contains the PvDlec2 promoter v2; the 2S 5' UTR; *Schizochytrium* sp. PFA1 v2; and At2S SSP terminator v1. The second PUFA synthase PTU contains the PvDlec2 promoter v2; 2S 5' UTR; *Schizochytrium* sp. PFA2 v2; and At2S SSP terminator v1. The third PUFA synthase PTU contains the PvDlec2 promoter v2; 2S 5' UTR; *Schizochytrium* sp. PFA3 v2; and At2S SSP terminator v1. The phosphopantetheinyl transferase PTU contains the PvDlec2 promoter v2; 2S 5' UTR; NoHetI v3; and At2S SSP terminator v1. These four PTUs described above were placed in a head-to-tail orientation within the T-strand DNA border regions of the plant transformation binary vector, pDAB7333. The order of the genes is: PFA1 v2, PFA2 v2, PFA3 v2, NoHetI v3. pDAB7333 also contains the phosphinothricin acetyl transferase PTU, as previously described. Recombinant plasmids were isolated and tested for incorporation of the PTUs with restriction enzyme digestion and DNA sequencing.

pDAB101496.

The pDAB101496 plasmid (SEQ ID NO:17) contains three PUFA synthase PTUs, one phosphopantetheinyl transferase PTU, and a phosphinothricin acetyl transferase PTU. Specifically, the first PUFA synthase PTU contains the PvDlec2 promoter v2; 2S 5' UTR; *Schizochytrium* sp. PFA1 v2; and At2S SSP terminator v1. The second PUFA synthase PTU contains the PvPhas promoter v4; PvPhas 5' UTR; *Schizochytrium* sp. PFA2 v2; and *Agrobacterium tumefaciens* Ti plasmid pTi15955 open reading frame 23/24 3' untranslated region (AtuORF23 3' UTR v1 GenBank Accession Number AF242881.1). The third PUFA synthase PTU contains the PvDlec2 promoter v2; 2S 5' UTR; *Schizochytrium* sp. PFA3 v3 (SEQ ID NO:13, which encodes the polypeptide of SEQ ID NO:14); and At2S SSP terminator v1. The phosphopantetheinyl transferase PTU contains the PvPhas promoter v5; PvPhas 5' UTR; NoHetI v3; and AtuORF23 3' UTR v1. These four PTUs were placed in a head-to-tail orientation within the T-strand DNA border regions of the plant transformation binary vector, pDAB7333. The order of the genes is: PFA1 v2, PFA2 v2, PFA3 v3, NoHetI v3. pDAB7333 also contains the phosphinothricin acetyl transferase PTU, as previously described. Recombinant plasmids were isolated and tested for incorporation of the PTUs with restriction enzyme digestion and DNA sequencing.

pDAB109525.

The pDAB109525 plasmid (SEQ ID NO:18) contains three PUFA synthase PTUs, one phosphopantetheinyl transferase PTU, and a phosphinothricin acetyl transferase PTU. Specifically, the first PUFA synthase PTU contains the PvDlec2 promoter v2; 2S 5' UTR; *Schizochytrium* sp. PFA1 v1; and At2S SSP terminator v1. The second PUFA synthase PTU contains the PvDlec2 promoter v2; 2S 5' UTR; *Schizochytrium* sp. PFA2 v1; and At2S SSP terminator v1. The third PUFA synthase PTU contains the PvDlec2 promoter v2; 2S 5' UTR; *Schizochytrium* sp. PFA3 v3; and At2S SSP terminator v1. The phosphopantetheinyl transferase PTU contains the PvDlec2 promoter v2; 2S 5' UTR; NoHetI v3; and At2S SSP terminator v1. These four PTUs were placed in a head-to-tail orientation within the T-strand DNA border regions of the plant transformation binary vector, pDAB7333. The order of the genes is: PFA1 v1, PFA2 v1, PFA3 v3, NoHetI v3. pDAB7333 also contains the phosphinothricin acetyl transferase PTU, as previously described. Recombinant plasmids containing the four PTUs were then isolated and tested for incorporation of the four PTUs with restriction enzyme digestion and DNA sequencing.

pDAB109584.

The pDAB109584 plasmid (SEQ ID NO:19) contains three PUFA synthase PTUs, one phosphopantetheinyl transferase PTU, and a phosphinothricin acetyl transferase PTU. Specifically, the first PUFA synthase PTU contains a *Brassica napus* napin gene promoter (BnaNapinC Promoter v1; GenBank Accession Number M64633.1), *Brassica napus* napin gene 5' untranslated region (BnaNapinC 5' UTR v1; GenBank Accession Number M64633.1), *Schizochytrium* sp. PFA1 v2; and *Brassica napus* napin gene 5' untranslated region (BnaNapinC 3' UTR v1; GenBank Accession Number M64633.1). The second PUFA synthase PTU contains a truncated *Phaseolus vulgaris* beta-phaseolin promoter (PvPhas promoter v4; GenBank Accession Number J01263.1); *Phaseolus vulgaris* beta-phaseolin 5' untranslated region (PvPhas 5' UTR; GenBank Accession Number J01263.1); *Schizochytrium* sp. PFA2 v2, *Phaseolus vulgaris* beta-phaseolin 3' untranslated region (PvPhas 3' UTR v1; GenBank Accession Number J01263.1); and *Phaseolus vulgaris* beta-phaseolin 3' MAR (PvPhas 3' MAR v2; GenBank Accession Number J01263.1). The third PUFA synthase PTU contains the PvDlec2 promoter v2; 2S 5' UTR; *Schizochytrium* sp. PFA3 v3; and At2S SSP terminator v1. The phosphopantetheinyl transferase PTU contains a *Brassica oleracea* acyl carrier protein gene promoter (BoACP promoter v1; International Publ. No. WO 1992/18634); *Brassica oleracea* acyl carrier protein gene 5' untranslated region (BoACP 5' UTR v2; International Publ. No. WO 1992/18634); NoHetI v3; and *Brassica napus* acyl carrier protein gene 3' untranslated region (BnACP05 3' UTR v1; GenBank Accession Number X64114.1). These four PTUs were placed in a head-to-tail orientation within the T-strand DNA border regions of the plant transformation binary vector, pDAB7333. The order of the genes is: PFA1 v2, PFA2 v2, PFA3 v3, NoHetI v3. pDAB7333 also contains the phosphinothricin acetyl transferase PTU, as previously described. Recombinant plasmids were isolated and tested for incorporation of the PTUs with restriction enzyme digestion and DNA sequencing.

pDAB109588.

The pDAB109588 plasmid (SEQ ID NO:20) contains three PUFA synthase PTUs, one phosphopantetheinyl transferase PTU, and a phosphinothricin acetyl transferase PTU. Specifically, the first PUFA synthase PTU contains a *Phaseolus vulgaris* beta-phaseolin promoter (PvPhas promoter v3; GenBank Accession Number J01263.1); PvPhas 5' UTR; *Schizochytrium* sp. PFA1 v2; PvPhas 3' UTR v1; and PvPhas 3' MAR v2. The second PUFA synthase PTU contains BnaNapinC Promoter v1; BnaNapinC 5' UTR v1; *Schizochytrium* sp. PFA2 v2; and BnaNapinC 3' UTR v1. The third PUFA synthase PTU contains PvDlec2 promoter v2; 2S 5' UTR; *Schizochytrium* sp. PFA3 v2; and At2S SSP terminator v1. The phosphopantetheinyl transferase PTU contains BoACP promoter v1; *Brassica oleracea* acyl carrier protein gene 5' untranslated region (BoACP 5' UTR v1; International Publ. No. WO 1992/18634); NoHetI v3; AtuORF23 3' UTR v1. These four PTUs were placed in a head-to-tail orientation within the T-strand DNA border regions of the plant transformation binary vector, pDAB7333. The order of the genes is: PFA1 v2, PFA2 v2, PFA3 v2, NoHetI v3. pDAB7333 also contains the phosphinothricin acetyl transferase PTU, as previously described. Recombinant plasmids were isolated and tested for incorporation of the PTUs with restriction enzyme digestion and DNA sequencing.

pDAB112210.

The pDAB112210 plasmid (SEQ ID NO:21) contains three PUFA synthase PTUs, one phosphopantetheinyl transferase PTU, and a phosphinothricin acetyl transferase PTU. Specifically, the first PUFA synthase PTU contains PvDlec2 promoter v2; 2S 5' UTR; *Schizochytrium* sp. PFA1 v1; and At2S SSP terminator v1. The second PUFA synthase PTU contains the PvDlec2 promoter v2; 2S 5' UTR; *Schizochytrium* sp. PFA2 v1; and At2S SSP terminator v1. The third PUFA synthase PTU contains the PvDlec2 promoter v2; 2S 5' UTR; *Schizochytrium* sp. PFA3 v1; and At2S SSP terminator v1. The phosphopantetheinyl transferase PTU contains the PvDlec2 promoter v2; 2S 5' UTR; NoHetI v3; and At2S SSP terminator v1. These four PTUs were placed in a head-to-tail orientation within the T-strand DNA border regions of the plant transformation binary vector, pDAB7333. The order of the genes is: PFA1 v1, PFA2 v1, PFA3 v1, NoHetI v1. pDAB7333 also contains the phosphinothricin acetyl transferase PTU, as previously described. Recombinant plasmids were isolated and tested for incorporation of the four PTUs with restriction enzyme digestion and DNA sequencing.

pDAB112206.

The pDAB112206 plasmid (SEQ ID NO:22) contains three PUFA synthase PTUs, one phosphopantetheinyl transferase PTU, and a phosphinothricin acetyl transferase PTU. Specifically, the first PUFA synthase PTU contains PvDlec2 promoter v2; 2S 5' UTR; *Schizochytrium* sp. PFA1 v2; and At2S SSP terminator v1. The second PUFA synthase PTU contains PvPhas promoter v4; PvPhas 5' UTR; *Schizochytrium* sp. PFA2 v2; PvPhas 3' UTR v1; and PvPhas 3' MAR v2. The third PUFA synthase PTU contains the PvDlec2 promoter v2; 2S 5' UTR; *Schizochytrium* sp. PFA3 v3; and At2S SSP terminator v1. The phosphopantetheinyl transferase PTU contains a truncated *Phaseolus vulgaris* beta-phaseolin promoter (PvPhas promoter v6; GenBank Accession Number J01263.1); PvPhas 5' UTR; NoHetI v3; PvPhas 3' UTR v1; and PvPhas 3' MAR v2. These four PTUs described above were placed in a head-to-tail orientation within the T-strand DNA border regions of the plant transformation binary vector, pDAB7333. The order of the genes is: PFA1 v2, PFA2 v2, PFA3 v3, NoHetI v3. pDAB7333 also contains the phosphinothricin acetyl transferase PTU, as previously described. Recombinant plasmids were isolated and tested for incorporation of the four PTUs with restriction enzyme digestion and DNA sequencing.

Second Orientation pDAB107962.

The pDAB107962 plasmid (SEQ ID NO:23) contains three PUFA synthase PTUs, one phosphopantetheinyl transferase PTU, and a phosphinothricin acetyl transferase PTU. Specifically, the first PUFA synthase PTU contains PvDlec2 promoter v2; 2S 5' UTR; *Schizochytrium* sp. PFA1 v2; and At2S SSP terminator v1. The phosphopantetheinyl transferase PTU contains PvPhas promoter v6; PvPhas 5' UTR; NoHetI v3; PvPhas 3' UTR v1; PvPhas 3' MAR v2; and AtuORF23 3' UTR v1. The second PUFA synthase PTU contains the PvDlec2 promoter v2; 2S 5' UTR; *Schizochytrium* sp. PFA3 v2; and At2S SSP terminator v1. The third PUFA synthase PTU contains the PvPhas promoter v6; PvPhas 5' UTR; *Schizochytrium* sp. PFA2 v1; PvPhas 3' UTR v1; PvPhas 3' MAR v2; and AtuORF23 3' UTR v1. PFA1 v2 and NoHetI v3 were placed in a tail-to-tail orientation, and an AtuORF23 3'UTR was placed between the two PTUs; NoHetI v3 and PFA3 v2 were placed in a head-to-head orientation; PFA3 v2 and PFA2 v1 were placed in a tail-to-tail orientation, and an AtuORF23 3'UTR was placed between the two PTUs within the T-strand DNA border regions of the plant transformation binary vector, pDAB7333. The order of the genes is: PFA1 v2, NoHetI v3, PFA3 v2, PFA2 v1. pDAB7333 also contains the phosphinothricin acetyl transferase PTU, as previously described. Recombinant plasmids were isolated and tested for incorporation of the PTUs with restriction enzyme digestion and DNA sequencing.

pDAB109591.

The pDAB109591 plasmid (SEQ ID NO:24) contains three PUFA synthase PTUs, one phosphopantetheinyl transferase PTU, and a phosphinothricin acetyl transferase PTU. Specifically, the first PUFA synthase PTU contains PvDlec2 promoter v2; 2S 5' UTR; *Schizochytrium* sp. PFA1 v2; and At2S SSP terminator v1. The phosphopantetheinyl transferase PTU contains PvPhas promoter v6; PvPhas promoter PvPhas 5' UTR; NoHetI v3; PvPhas 3' UTR v1; PvPhas 3' MAR v2; and AtuORF23 3' UTR v1. The second PUFA synthase PTU contains the PvDlec2 promoter v2; 2S 5' UTR; *Schizochytrium* sp. PFA3 v3; and At2S SSP terminator v1. The third PUFA synthase PTU contains the PvPhas promoter v6; PvPhas 5' UTR; *Schizochytrium* sp. PFA2 v2; PvPhas 3' UTR v1; PvPhas 3' MAR v2; and AtuORF23 3' UTR v1. PFA1 v2 and NoHetI v3 were placed in a tail-to-tail orientation, and an AtuORF23 3'UTR was placed between the two PTUs; NoHetI v3 and PFA3 v3 were placed in a head-to-head orientation; PFA3 v3 and PFA2 v2 were placed in a tail-to-tail orientation, and an AtuORF23 3'UTR was placed between the two PTUs within the T-strand DNA border regions of the plant transformation binary vector, pDAB7333. The order of the genes is: PFA1 v2, NoHetI v3, PFA3 v3, PFA2 v2. pDAB7333 also contains the phosphinothricin acetyl transferase PTU, as previously described. Recombinant plasmids were isolated and tested for incorporation of the PTUs with restriction enzyme digestion and DNA sequencing.

pDAB109592.

The pDAB109592 plasmid (SEQ ID NO:25) contains three PUFA synthase PTUs, one phosphopantetheinyl transferase PTU, and a phosphinothricin acetyl transferase PTU. Specifically, the first PUFA synthase PTU contains BnaNapinC Promoter v1; BnaNapinC 5' UTR v1; *Schizochytrium* sp. PFA1 v2; and BnaNapinC 3' UTR v1. The phosphopantetheinyl transferase PTU contains BoACP promoter v1; *Brassica oleracea* acyl carrier protein gene 5' untranslated region (BoACP 5' UTR v2; International Publ. No. WO 1992/18634); NoHetI v3; BnACP05 3' UTR v1; and AtuORF23 3' UTR v1. The second PUFA synthase PTU contains PvDlec2 promoter v2; 2S 5' UTR; *Schizochytrium* sp. PFA3 v3; and At2S SSP terminator v1. The third PUFA synthase PTU contains PvPhas promoter v6; *Phaseolus vulgaris* beta-phaseolin 5' untranslated region (PvPhas promoter PvPhas 5' UTR; GenBank Accession Number J01263.1); *Schizochytrium* sp. PFA2 v2; PvPhas 3' UTR v1;

PvPhas 3' MAR v2; and AtuORF23 3' UTR v1. PFA1 v2 and NoHetI v3 were placed in a tail-to-tail orientation, and an AtuORF23 3'UTR was placed between the two PTUs; NoHetI v3 and PFA3 v3 were placed in a head-to-head orientation; PFA3 v3 and PFA2 v2 were placed in a tail-to-tail orientation, and an AtuORF23 3'UTR was placed between the two PTUs within the T-strand DNA border regions of the plant transformation binary vector, pDAB7333. The order of the genes is: PFA1 v2, NoHetI v3, PFA3 v3, PFA2 v2. pDAB7333 also contains the phosphinothricin acetyl transferase PTU, as previously described. Recombinant plasmids containing the four PTUs were then isolated and tested for incorporation of the four PTUs with restriction enzyme digestion and DNA sequencing.

pDAB107960.

The pDAB107960 plasmid (SEQ ID NO:26) contains three PUFA synthase PTUs, one phosphopantetheinyl transferase PTU, and a phosphinothricin acetyl transferase PTU. Specifically, the first PUFA synthase PTU contains PvDlec2 promoter v2; 2S 5' UTR; *Schizochytrium* sp. PFA1 v1; and At2S SSP terminator v1. The phosphopantetheinyl transferase PTU contains PvPhas promoter v6; PvPhas promoter PvPhas 5' UTR; NoHetI v3; PvPhas 3' UTR v1; PvPhas 3' MAR v2; AtuORF23 3' UTR v1. The second PUFA synthase PTU contains the PvDlec2 promoter v2; 2S 5' UTR; *Schizochytrium* sp. PFA3 v3; and At2S SSP terminator v1. The third PUFA synthase PTU contains the PvPhas promoter v6; PvPhas 5' UTR; *Schizochytrium* sp. PFA2 v1; PvPhas 3' UTR v1; PvPhas 3' MAR v2; and AtuORF23 3' UTR v1. PFA1 v1 and NoHetI v3 were placed in a tail-to-tail orientation, and an AtuORF23 3'UTR is placed between the two PTUs; NoHetI v3 and PFA3 v3 were placed in a head-to-head orientation; PFA3 v3 and PFA2 v1 were placed in a tail-to-tail orientation, and an AtuORF23 3'UTR is placed between the two PTUs within the T-strand DNA border regions of the plant transformation binary vector, pDAB7333. The order of the genes is: PFA1 v1, NoHetI v3, PFA3 v3, PFA2 v1. pDAB7333 also contains the phosphinothricin acetyl transferase PTU, as previously described. Recombinant plasmids were isolated and tested for incorporation of the PTUs with restriction enzyme digestion and DNA sequencing.

pDAB110132.

The pDAB110132 plasmid (SEQ ID NO:27) contains three PUFA synthase PTUs, one phosphopantetheinyl transferase PTU, and a phosphinothricin acetyl transferase PTU. Specifically, the first PUFA synthase PTU contains a *Phaseolus vulgaris* beta-phaseolin promoter (PvPhas promoter v3; GenBank Accession Number J01263.1); *Phaseolus vulgaris* beta-phaseolin 5' untranslated region (PvPhas promoter PvPhas 5' UTR; GenBank Accession Number J01263.1); *Schizochytrium* sp. PFA1 v2; PvPhas 3' UTR v1; and PvPhas 3' MAR v2. The phosphopantetheinyl transferase PTU contains BoACP promoter v1; BoACP 5' UTR v2; NoHetI v3; BnACP05 3' UTR v1; and AtuORF23 3' UTR v1. The second PUFA synthase PTU contains PvDlec2 promoter v2; 2S 5' UTR; *Schizochytrium* sp. PFA3 v2; and At2S SSP terminator v1. The third PUFA synthase PTU contains BnaNapinC Promoter v1; BnaNapinC 5' UTR v1; *Schizochytrium* sp. PFA2 v1; BnaNapinC 3' UTR v1; and AtuORF23 3' UTR v1. PFA1 v2 and NoHetI v3 were placed in a tail-to-tail orientation, and an AtuORF23 3'UTR was placed between the two PTUs; NoHetI v3 and PFA3 v2 were placed in a head-to-head orientation; PFA3 v2 and PFA2 v1 were placed in a tail-to-tail orientation, and an AtuORF23 3'UTR was placed between the two PTUs within the T-strand DNA border regions of the plant transformation binary vector, pDAB7333. The order of the genes is: PFA1 v2, NoHetI v3, PFA3 v2, PFA2 v1. pDAB7333 also contains the phosphinothricin acetyl transferase PTU, as previously described. Recombinant plasmids were isolated and tested for incorporation of the PTUs with restriction enzyme digestion and DNA sequencing.

pDAB107961.

The pDAB107961 plasmid (SEQ ID NO:28) contains three PUFA synthase PTUs, one phosphopantetheinyl transferase PTU, and a phosphinothricin acetyl transferase PTU. Specifically, the first PUFA synthase PTU contains PvPhas promoter v3; PvPhas promoter PvPhas 5' UTR; *Schizochytrium* sp. PFA1 v1; PvPhas 3' UTR v1; and PvPhas 3' MAR v2. The phosphopantetheinyl transferase PTU contains BoACP promoter v1; BoACP 5' UTR v2; NoHetI v3; BnACP05 3' UTR v1; and AtuORF23 3' UTR v1. The second PUFA synthase PTU contains PvDlec2 promoter v2; 2S 5' UTR; *Schizochytrium* sp. PFA3 v3; and At2S SSP terminator v1. The third PUFA synthase PTU contains BnaNapinC Promoter v1; BnaNapinC 5' UTR v1; *Schizochytrium* sp. PFA2 v1; BnaNapinC 3' UTR v1; and AtuORF23 3' UTR v1. PFA1 v1 and NoHetI v3 were placed in a tail-to-tail orientation, and an AtuORF23 3'UTR was placed between the two PTUs; NoHetI v3 and PFA3 v3 were placed in a head-to-head orientation; PFA3 v3 and PFA2 v1 were placed in a tail-to-tail orientation, and an AtuORF23 3'UTR was placed between the two PTUs within the T-strand DNA border regions of the plant transformation binary vector, pDAB7333. The order of the genes is: PFA1 v1, NoHetI v3, PFA3 v3, PFA2 v1. pDAB7333 also contains the phosphinothricin acetyl transferase PTU, as previously described. Recombinant plasmids were isolated and tested for incorporation of the PTUs with restriction enzyme digestion and DNA sequencing.

pDAB110151.

The pDAB110151 plasmid (SEQ ID NO:29) contains three PUFA synthase PTUs, one phosphopantetheinyl transferase PTU, and a phosphinothricin acetyl transferase PTU. Specifically, the first PUFA synthase PTU contains BnaNapinC Promoter v1; BnaNapinC 5' UTR v1; *Schizochytrium* sp. PFA1 v2; and BnaNapinC 3' UTR v1. The phosphopantetheinyl transferase PTU contains PvPhas promoter v6; PvPhas promoter PvPhas 5' UTR; NoHetI v3; PvPhas 3' UTR v1; PvPhas 3' MAR v2; and AtuORF23 3' UTR v1. The second PUFA synthase PTU contains the BnaNapinC Promoter v1; BnaNapinC 5' UTR v1; *Schizochytrium* sp. PFA3 v2; and At2S SSP terminator v1. The third PUFA synthase PTU contains PvDlec2 promoter v2; 2S 5' UTR; *Schizochytrium* sp. PFA2 v1; and At2S SSP terminator v1. PFA1 v2 and NoHetI v3 were placed in a tail-to-tail orientation, and an AtuORF23 3'UTR was placed between the two PTUs; NoHetI v3 and PFA3 v2 were placed in a head-to-head orientation; PFA3 v2 and PFA2 v1 were placed in a tail-to-tail orientation, and an AtuORF23 3'UTR was placed between the two PTUs within the T-strand DNA border regions of the plant transformation binary vector, pDAB7333. The order of the genes is: PFA1 v2, NoHetI v3, PFA3 v2, PFA2 v1. pDAB7333 also contains the phosphinothricin acetyl transferase PTU, as previously described. Recombinant plasmids were isolated and tested for incorporation of the PTUs with restriction enzyme digestion and DNA sequencing.

pDAB112285.

The pDAB112285 plasmid (SEQ ID NO:30) contains three PUFA synthase PTUs, one phosphopantetheinyl transferase PTU, and a phosphinothricin acetyl transferase PTU. Specifically, the first PUFA synthase PTU contains PvDlec2 promoter v2; 2S 5' UTR; *Schizochytrium* sp. PFA1 v2; and At2S SSP terminator v1. The phosphopantetheinyl transferase PTU contains PvPhas promoter v6; PvPhas promoter PvPhas 5' UTR; NoHetI v3; PvPhas 3' UTR v1; PvPhas 3' MAR v2; and AtuORF25/26 3' UTR v3. The second PUFA synthase PTU contains PvDlec2 promoter v2; 2S 5' UTR; *Schizochytrium* sp. PFA3 v2; and At2S SSP terminator v1. The third PUFA synthase PTU contains PvPhas promoter v6; PvPhas 5' UTR; *Schizochytrium* sp. PFA2 v1; PvPhas 3' UTR v1; PvPhas 3' MAR v2; and AtuORF23 3' UTR v1. PFA1 v2 and NoHetI v3 were placed in a tail-to-tail orientation, and an AtuORF25/26 3'UTR was placed between the two PTUs; NoHetI v3 and PFA3 v2 were placed in a head-to-head orientation; PFA3 v2 and PFA2 v1 were placed in a tail-to-tail orientation, and an AtuORF23 3'UTR was placed between the two PTUs within the T-strand DNA border regions of the plant transformation binary vector, pDAB7333. The order of the genes is: PFA1 v2, NoHetI v3, PFA3 v2, PFA2 v1. pDAB7333 also contains the phosphinothricin acetyl transferase PTU, as previously described. Recombinant plasmids were then isolated and tested for incorporation of the PTUs with restriction enzyme digestion and DNA sequencing.

pDAB117501.

The pDAB117501 plasmid (SEQ ID NO:31) contains three PUFA synthase PTUs, one phosphopantetheinyl transferase PTU, and a phosphinothricin acetyl transferase PTU. Specifically, the first PUFA synthase PTU contains PvDlec2 promoter v2; 2S 5' UTR; *Schizochytrium* sp. PFA1 v1; and At2S SSP terminator v1. The phosphopantetheinyl transferase PTU contains PvPhas promoter v6; PvPhas promoter PvPhas 5' UTR; NoHetI v3; PvPhas 3' UTR v1; PvPhas 3' MAR v2; GenBank Accession Number J01263.1; and AtuORF25/26 3' UTR v3. The second PUFA synthase PTU contains a *Glycine max* beta-conglycinin alpha prime subunit gene promoter and 5' untranslated region (SSPRO2745.1; GenBank Accession Number GU723691.1); *Schizochytrium* sp. PFA3 v1; PvPhas 3' UTR v1; and PvPhas 3' MAR v2. The third PUFA synthase PTU contains BnaNapinC Promoter v1; BnaNapinC 5' UTR v1; *Schizochytrium* sp. PFA2 v1; BnaNapinC 3' UTR v1. PFA1 v1 and NoHetI v3 were placed in a tail-to-tail orientation, and an AtuORF25/26 3'UTR was placed between the two PTUs; NoHetI v3 and PFA3 v1 were placed in a head-to-head orientation; PFA3 v1 and PFA2 v1 were placed in a tail-to-tail orientation, and an AtuORF23 3'UTR was placed between the two PTUs within the T-strand DNA border regions of the plant transformation binary vector, pDAB7333. The order of the genes is: PFA1 v1, NoHetI v3, PFA3 v1, PFA2 v1. pDAB7333 also contains the phosphinothricin acetyl transferase PTU, as previously described. Recombinant plasmids were isolated and tested for incorporation of the PTUs with restriction enzyme digestion and DNA sequencing.

pDAB117502.

The pDAB117502 plasmid (SEQ ID NO:32) contains three PUFA synthase PTUs, one phosphopantetheinyl transferase PTU, and a phosphinothricin acetyl transferase PTU. Specifically, the first PUFA synthase PTU contains PvPhas promoter v3; PvPhas promoter PvPhas 5' UTR; *Schizochytrium* sp. PFA1 v1; PvPhas 3' UTR v1; and PvPhas 3' MAR v2. The phosphopantetheinyl transferase PTU contains BnaNapinC Promoter v1; BnaNapinC 5' UTR v1; NoHetI v3; BnaNapinC 3' UTR v1; and AtuORF25/26 3' UTR v1. The second PUFA synthase PTU contains PvDlec2 promoter v2; 2S 5' UTR; *Schizochytrium* sp. PFA3 v1; and At2S SSP terminator v1. The third PUFA synthase PTU contains a SSPRO2745.1; *Schizochytrium* sp. PFA2 v1; PvPhas 3' UTR v1; and PvPhas 3' MAR v2. PFA1 v1 and NoHetI v3 were placed in a tail-to-tail orientation, and an AtuORF25/26 3'UTR was placed between the two PTUs; NoHetI v3 and PFA3 v1 were placed in a head-to-head orientation; PFA3 v1 and PFA v1 were placed in a tail-to-tail orientation, and an AtuORF23 3'UTR was placed between the two PTUs within the T-strand DNA border regions of the plant transformation binary vector, pDAB7333. The order of the genes is: PFA1 v1, NoHetI v3, PFA3 v1, PFA2 v1. pDAB7333 also contains the phosphinothricin acetyl transferase PTU, as previously described. Recombinant plasmids were isolated and tested for incorporation of the PTUs with restriction enzyme digestion and DNA sequencing.

Third Orientation pDAB112200.

The pDAB112200 plasmid (SEQ ID NO:33) contains three PUFA synthase PTUs, one phosphopantetheinyl transferase PTU, and a phosphinothricin acetyl transferase PTU. Specifically, the first PUFA synthase PTU contains PvDlec2 promoter v2; 2S 5' UTR; *Schizochytrium* sp. PFA1 v2; and At2S SSP terminator v1. The phosphopantetheinyl transferase PTU contains PvPhas promoter v4; PvPhas 5' UTR; NoHetI v3; AtuORF23 3' UTR v1; and a random DNA spacer. The second PUFA synthase PTU contains PvDlec2 promoter v2; 2S 5' UTR; *Schizochytrium* sp. PFA3 v2; and At2S SSP terminator v1. The third PUFA synthase PTU contains PvPhas promoter v5; PvPhas 5' UTR; *Schizochytrium* sp. PFA2 v2; and AtuORF23 3' UTR v1. PFA1 v2 and NoHetI v3 were placed in a head-to-head orientation; NoHetI v3 and PFA3 v2 were placed in a tail-to-tail orientation with a random DNA spacer placed between the two PTUs; PFA3 v2 and PFA2 v2 were placed in a head-to-head orientation within the T-strand DNA border regions of the plant transformation binary vector, pDAB7333. The order of the genes is: PFA1 v2, NoHetI v3, PFA3 v2, PFA2 v2. pDAB7333 also contains the phosphinothricin acetyl transferase PTU, as previously described. Recombinant plasmids were isolated and tested for incorporation of the PTUs with restriction enzyme digestion and DNA sequencing.

pDAB112201.

The pDAB112201 plasmid (SEQ ID NO:34) contains three PUFA synthase PTUs, one phosphopantetheinyl transferase PTU, and a phosphinothricin acetyl transferase PTU. Specifically, the first PUFA synthase PTU contains a *Lesquerella fendleri* 3-ketoacyl-CoA synthase gene promoter and 5' untranslated region (LfKCS3 promoter v2; GenBank Accession Number AF367052.1); *Schizochytrium* sp. PFA1 v2; and 3-ketoacyl-CoA synthase gene 3' untranslated region (SSTER2742.1; GenBank Accession Number AF367052.1). The phosphopantetheinyl transferase PTU contains BoACP promoter v1; BoACP 5' UTR v2; NoHetI v3; BnACP05 3' UTR v1; and a random DNA spacer. The second PUFA synthase PTU contains the LfKCS3 promoter v2; *Schizochytrium* sp. PFA3 v2; and SSTER2742.1. The third PUFA synthase PTU contains BoACP promoter v1; BoACP 5' UTR v2; *Schizochytrium* sp. PFA2 v2; and BnACP05 3' UTR v1. PFA1 v2 and NoHetI v3 were placed in a head-to-head orientation; NoHetI v3 and PFA3 v2 were placed in a tail-to-tail orientation with a random DNA spacer placed between the two PTUs; PFA3 v2 and PFA2 v2 were placed in a head-to-head orientation within the T-strand DNA border regions of the plant transformation binary vector, pDAB7333. The order of the genes is: PFA1 v2, NoHetI v3, PFA3 v2, PFA2 v2. pDAB7333 also contains the phosphinothricin acetyl transferase PTU, as previously described. Recombinant plasmids were isolated and tested for incorporation of the PTUs with restriction enzyme digestion and DNA sequencing.

pDAB112203.

The pDAB112203 plasmid (SEQ ID NO:35) contains three PUFA synthase PTUs, one phosphopantetheinyl transferase PTU, and a phosphinothricin acetyl transferase PTU. Specifically, the first PUFA synthase PTU contains SSPRO2745.1; *Schizochytrium* sp. PFA1 v2; PvPhas 3' UTR v1; and PvPhas 3' MAR v2. The phosphopantetheinyl transferase PTU contains a *Glycine max* kunitz trypsin inhibitor 3 gene promoter and 5' untranslated region (SSPRO2743.1; GenBank Accession Number AF233296.1); NoHetI v3; *Glycine max* kunitz trypsin inhibitor 3 gene 3' untranslated region (SSTER2744.1; GenBank Accession Number AF233296.1); and a random DNA spacer. The second PUFA synthase PTU contains SSPRO2745.1; *Schizochytrium* sp. PFA3 v2; PvPhas 3' UTR v1; and PvPhas 3' MAR v2. The third PUFA synthase PTU contains SSPRO2743.1; *Schizochytrium* sp. PFA2 v2; and SSTER2744.1. PFA1 v2 and NoHetI v3 were placed in a head-to-head orientation; NoHetI v3 and PFA3 v2 were placed in a tail-to-tail orientation with a random DNA spacer placed between the two PTUs; PFA3 v2 and PFA2 v2 were placed in a head-to-head orientation within the T-strand DNA border regions of the plant transformation binary vector, pDAB7333. The order of the genes is: PFA1 v2, NoHetI v3, PFA3 v2, PFA2 v2. pDAB7333 also contains the phosphinothricin acetyl transferase PTU, as previously described. Recombinant plasmids were isolated and tested for incorporation of the PTUs with restriction enzyme digestion and DNA sequencing.

pDAB112205.

The pDAB112205 plasmid (SEQ ID NO:36) contains three PUFA synthase PTUs, one phosphopantetheinyl transferase PTU, and a phosphinothricin acetyl transferase PTU. Specifically, the first PUFA synthase PTU contains PvDlec2 promoter v2; 2S 5' UTR; *Schizochytrium* sp. PFA1 v2; and At2S SSP terminator v1. The phosphopantetheinyl transferase PTU contains BoACP promoter v1; BoACP 5' UTR v2; NoHetI v3; BnACP05 3' UTR v1; and a random DNA spacer. The second PUFA synthase PTU contains SSPRO2743.1; *Schizochytrium* sp. PFA3 v2; and SSTER2744.1. The third PUFA synthase PTU contains SSPRO2745.1; *Schizochytrium* sp. PFA2 v2; PvPhas 3' UTR v1; and PvPhas 3' MAR v2. PFA1 v2 and NoHetI v3 were placed in a head-to-head orientation; NoHetI v3 and PFA3 v2 were placed in a tail-to-tail orientation with a random DNA spacer placed between the two PTUs; PFA3 v2 and PFA2 v2 were placed in a head-to-head orientation within the T-strand DNA border regions of the plant transformation binary vector, pDAB7333. The order of the genes is: PFA1 v2, NoHetI v3, PFA3 v2, PFA2 v2. pDAB7333 also contains the phosphinothricin acetyl transferase PTU, as previously described. Recombinant plasmids were then isolated and tested for incorporation of the PTUs with restriction enzyme digestion and DNA sequencing.

pDAB112208.

The pDAB112208 plasmid (SEQ ID NO:37) contains three PUFA synthase PTUs, one phosphopantetheinyl transferase PTU, and a phosphinothricin acetyl transferase PTU. Specifically, the first PUFA synthase PTU contains SSPRO2743.1; *Schizochytrium* sp. PFA1 v2; and SSTER2744.1. The phosphopantetheinyl transferase PTU contains SSPRO2745.1; NoHetI v3; PvPhas 3' UTR v1; PvPhas 3' MAR v2; and a random DNA spacer. The second PUFA synthase PTU contains SSPRO2743.1; *Schizochytrium* sp. PFA3 v2; and SSTER2744.1. The third PUFA synthase PTU contains SSPRO2745.1; *Schizochytrium* sp. PFA2 v2; and PvPhas 3' MAR v2. PFA1 v2 and NoHetI v3 were placed in a head-to-head orientation; NoHetI v3 and PFA3 v2 were placed in a tail-to-tail orientation with a random DNA spacer placed between the two PTUs; PFA3 v2 and PFA2 v2 were placed in a head-to-head orientation within the T-strand DNA border regions of the plant transformation binary vector, pDAB7333. The order of the genes is: PFA1 v2, NoHetI v3, PFA3 v2, PFA2 v2. pDAB7333 also contains the phosphinothricin acetyl transferase PTU, as previously described. Recombinant plasmids were isolated and tested for incorporation of the PTUs with restriction enzyme digestion and DNA sequencing.

pDAB112209.

The pDAB112209 plasmid (SEQ ID NO:38) contains three PUFA synthase PTUs, one phosphopantetheinyl transferase PTU, and a phosphinothricin acetyl transferase PTU. Specifically, the first PUFA synthase PTU contains SSPRO2743.1; *Schizochytrium* sp. PFA1 v2; and SSTER2744.1. The phosphopantetheinyl transferase PTU contains BoACP promoter v1; BoACP 5' UTR v2; NoHetI v3; BnACP05 3' UTR v1; and random DNA spacer. The second PUFA synthase PTU contains SSPRO2745.1; *Schizochytrium* sp. PFA3 v2; PvPhas 3' UTR v1; and PvPhas 3' MAR v2. The third PUFA synthase PTU contains PvDlec2 promoter v2; 2S 5' UTR; *Schizochytrium* sp. PFA2 v2; and At2S SSP terminator v1. PFA1 v2 and NoHetI v3 were placed in a head-to-head orientation; NoHetI v3 and PFA3 v2 were placed in a tail-to-tail orientation with a random DNA spacer placed between the two PTUs; PFA3 v2 and PFA2 v2 were placed in a head-to-head orientation within the T-strand DNA border regions of the plant transformation binary vector, pDAB7333. The order of the genes is: PFA1 v2, NoHetI v3, PFA3 v2, PFA2 v2. pDAB7333 also contains the phosphinothricin acetyl transferase PTU, as previously described. Recombinant plasmids were isolated and tested for incorporation of the PTUs with restriction enzyme digestion and DNA sequencing.

*Agrobacterium tumefaciens* Transformation.

Selected binary constructs were transformed into *Agrobacterium* strains for plant transformations. The strains that were selected for transformation were derivatives of *A. tumefaciens* strain EHA 105. The following two *A. tumefaciens* strains, AGL1 and DA2552 (See International Patent Publication No. WO2012016222) were transformed with the binary constructs, and confirmed via restriction enzyme digestion and sequencing.

*Arabidopsis* $T_0$ events transformed with *Agrobacterium tumefaciens* harboring binary plasmids encoding PUFA synthase genes and HetI (and in some cases SzACS2) under the control of plant expression elements as described above were generated using the floral dip method essentially as described in Clough and Bent (1998) Plant J. 16(6):735-43. The *Arabidopsis* $T_0$ events were obtained and selected to grow to maturity and self-fertilized. The resulting $T_1$ seed was harvested and sown. Transformed $T_1$ plants were selected by spraying with phosphinothricin to select for those plants containing a functional pat gene as a selectable marker. Leaf tissue from the surviving $T_1$ plants was sampled and analyzed by quantitative PCR reactions specific for the pat gene to identify those plants containing a single copy of the selectable marker (and associated transgenes). These plants were grown to maturity, and the $T_2$ seed was harvested and analyzed for LC-PUFA content (as % of total extractable FAMEs).

Canola Transformation.

Seed Germination.

Wild-type canola seeds (variety DH12075; ncbi.nlm.nih.gov/pmc/articles/PMC1456120/) were surface-sterilized in 10% Clorox for 10 minutes and rinsed three times with sterile distilled water (seeds are contained in steel strainers during this process). Seeds were planted for germination on ½ MS Canola medium (½× MS, 2% sucrose, 0.8% agar) contained in phytatrays, 25 seeds per phytatray and placed in a Percival Growth Chamber™ with growth regime set at 25° C., a photoperiod of 16 hours light, 8 hours dark; and germinated for 5 days.

Pre-Treatment.

On day 5, hypocotyl segments of about 3 mm in length were aseptically excised, discarding the root and shoot sections (drying of hypocotyls is prevented by placing hypocotyls segments into 10 ml of sterile MILLIQ® water during excision process). Hypocotyl segments were placed horizontally on sterile filter paper on callus induction medium MSK1D1 (1× MS, 1 mg/L kinetin, 1 mg/L 2,4-D, 3% sucrose, 0.7% PHYTAGAR®) for 3 days pre-treatment in a Percival Growth Chamber™ with a growth regime set at 22-23° C., and a photoperiod of 16 hours light, 8 hours dark.

Co-Cultivation with *Agrobacterium*.

The day before *Agrobacterium* treatment, flasks of YEP medium containing the appropriate antibiotics were inoculated. Hypocotyl segments were transferred from filter paper to empty 100×25 mm petri dishes containing 10 mL liquid M medium to prevent the hypocotyl segments from drying. A spatula was used at this stage to scoop the segments and transfer. The liquid M medium was removed with a pipette, and 40 mL *Agrobacterium* suspension was added to the petri dish (500 segments with 40 mL *Agrobacterium* solution). The segments were treated for 30 minutes with periodic swirling of the petri dish, so that the hypocotyls could stay immersed in the *Agrobacterium* solution.

At the end of the treatment period, the *Agrobacterium* solution was pipetted into a waste beaker, autoclaved and discarded (the *Agrobacterium* solution was completely removed to prevent *Agrobacterium* overgrowth). The treated hypocotyls were transferred with forceps back to the original plates containing MSK1D1 with filter paper (care was taken to ensure that the segments did not dry). The hypocotyl segments along with control segments were returned to the Percival Growth Chamber™ under reduced light intensity (by covering the plates with aluminum foil), and the treated hypocotyls were co-cultivated with *Agrobacterium* for 3 days.

Callus Induction on Selection Medium.

After 3 days of co-cultivation, the hypocotyl segments were transferred individually with forceps onto callus induction medium MSK1D1H1 (1× MS, 1 mg/L Kinetin, 1 mg/L 2,4-D, 0.5 gm/L MES, 5 mg/L AgNo₃, 300 mg/L TIMENTIN®, 200 mg/L Carbenicillin™, 1 mg/L Herbiace™, 3% sucrose, 0.7% PHYTAGAR®). The hypocotyl segments were anchored on the medium, but were not embedded in the medium.

Selection and Shoot Regeneration.

After 7 days on callus induction medium, the callusing hypocotyl segments were transferred to Shoot Regeneration Medium 1 with selection MSB3Z1H1 (1× MS, 3 mg/L BAP, 1 mg/L zeatin, 0.5 gm/L MES, 5 mg/L AgNO₃, 300 mg/L TIMENTIN®, 200 mg/L Carbenicillin™, 1 mg/L Herbiace™, 3% sucrose, 0.7% PHYTAGAR®). After 14 days, the hypocotyls with shoots were transferred to Regeneration Medium 2 with increased selection MSB3Z1H3 (1× MS, 3 mg/L BAP, 1 mg/L zeatin, 0.5 gm/L MES, 5 mg/L AgNO₃, 300 mg/L TIMENTIN®, 200 mg/L Carbenicillin™, 3 mg/L Herbiace™, 3% sucrose, 0.7% PHYTAGAR®).

Shoot Elongation.

After 14 days, the segments with shoots were transferred to shoot elongation medium MSMESH5 (1× MS, 300 mg/L TIMENTIN®, 5 mg/L Herbiace™, 2% sucrose, 0.7% TC Agar™). Shoots that were already elongated were isolated and transferred to MSMESH5. After 14 days, the remaining shoots which did elongate in the first round were placed on MSMESH5, and transferred to fresh selection medium of the same composition. At this stage, all remaining hypocotyl segments were discarded. Shoots that elongate on MSB3Z1H3 medium after 2 weeks were isolated and transferred to MSMESH5 medium. Remaining shoots that did elongate in the first round on MSMESH5 were isolated and transferred to fresh selection medium of the same composition. At this stage, all remaining hypocotyl segments were discarded.

Root Induction.

After 14 days, the shoots were transferred to MSMEST medium (1× MS, 0.5 g/L MES, 300 mg/L TIMENTIN®, 2% sucrose, 0.7% TC Agar™) for root induction. The shoots that did not root in the first transfer on MSMEST medium were transferred for a second or third cycle on MSMEST medium until rooted plants were obtained.

PCR Analysis.

Samples for PCR were isolated after the shoots were cultured on MSMESH5 medium for at least 14 days. Leaf tissue from the green shoots was tested by PCR for the presence of the pat selectable marker gene. All chlorotic shoots were discarded and not subjected to the PCR assay. Samples that were positive for the PCR reaction were kept and the shoots were left on the MSMEST medium to elongate and develop roots. The shoots that were negative according to the PCR assay were discarded. Plants that rooted on MSMESH5 or MSMEST and were PCR-positive were sent for transplanting into soil. After hardening, the T₀ canola plants were further analyzed for events which contain all of the transgene PTU cassettes, and these plants were transferred to the greenhouse, grown to maturity, and the T₁ seed was harvested for fatty acid composition analysis.

Soybean Transformation.

Cotyledonary Node Soybean.

*Agrobacterium*-mediated transformation of soybean (*Glycine max* c.v., Maverick) was performed using an *Agrobacterium*-strain harboring a binary vector via a modified procedure of Zeng et al. (2004) Plant Cell Rep. 22(7): 478-82. The protocol was modified to include the herbicide glufosinate as a selective agent. In addition, another modification included the germination of sterilized soybean seeds on B5 basal medium (Gamborg et al. (1968) Exp Cell Res. 50(1): 151-8) solidified with 3 g/L Phytagel™ (Sigma-Aldrich, St. Louis, Mo.). The final modification to the protocol deployed the use of cotyledonary node explants that were prepared from 5-6 days old seedlings and infected with *Agrobacterium* as described by Zhang et al. (1999) Plant Cell Tiss. Org. 56: 37-46. As described in Zeng et al. (2004), co-cultivation was carried out for 5 days on the co-cultivation medium. Shoot initiation, shoot elongation, and rooting media were supplemented with 50 mg/L Cefotaxime™, 50 mg/L TIMENTIN®, and 50 mg/L Vancomycin™, and solidified with 3 g/L Phytagel™.

Split Seed Soybean Transformation Method.

*Agrobacterium*-mediated transformation of soybean (*Glycine max* c.v., Maverick) was performed using an *Agrobacterium*-strain harboring a binary vector via a modification of the procedure of Paz et al. (2005) Plant Cell Rep. 25:206-13. Briefly, soybean seeds were cut in half by a longitudinal cut along the hilum to separate the seed and remove the seed coat. The embryonic axis was excised and any axial shoots/buds were removed from the cotyledonary node. The resulting half seed explants were infected with *Agrobacterium*. Shoot initiation, shoot elongation, and rooting media were supplemented with 50 mg/L Cefotaxime™, 50 mg/L TIMENTIN®, and 50 mg/L Vancomycin™ and solidified with 3 g/L Phytagel™. Glufosinate selection was employed to inhibit the growth of non-transformed shoots.

Split Seed with Partial Embryo Axis Soybean Transformation Method.

*Agrobacterium*-mediated transformation of soybean (*Glycine max* c.v., Maverick) was performed using an *Agrobacterium*-strain harboring a binary vector via the split-seed explant with partial embryo axis soybean transformation protocol described in U.S. Provisional Application No. 61/739,349, herein incorporated by reference. After transformation, the soybean tissues were cultured using the tissue culture methods described in U.S. Provisional Application No. 61/739,349. Glufosinate selection was employed to inhibit the growth of non-transformed shoots. Selected shoots were transferred to rooting medium for root development and then transferred to soil mix for acclimatization of plantlets.

Terminal leaflets of selected plantlets were treated topically (leaf paint technique) with glufosinate to screen for putative transformants. The screened plantlets were transferred to the greenhouse, allowed to acclimate, and then leaf-painted with glufosinate to reconfirm tolerance. These putative transformed $T_0$ plants were sampled, and molecular analyses was used to confirm the presence of transgenes within the PTUs. Identified $T_0$ plants were allowed to self-fertilize in the greenhouse to produce $T_1$ seed for fatty acid composition analysis.

Lipid Analysis of Mature $T_1$ Seed from Transgenic Soybean Events.

$T_0$ plants from 3 constructs, pDAB101454, pDAB101496 and pDAB107960, were grown to maturity in the greenhouse. Plants were selected that contained copies of PAT v5 and the accompanying four genes for DHA production. These plants were self-fertilized and the resulting $T_1$ seed harvested at maturity. Single seeds were analyzed via FAMEs GC-FID to determine the LC-PUFAs and DHA content in the $T_1$ soybean seed. Twelve whole mature seeds per plant were individually analyzed by crushing the seed with a press and homogenization using a steel ball and ball mill (Spex SamplePrep, LLC). The tissue was defatted three times with hexane, the pooled hexane fractions were evaporated to dryness and the residue weighed and reconstituted in heptane for FAME analysis. A known amount of oil residue was transmethylated with 0.25 M of freshly prepared sodium methoxide (Sigma-Aldrich, St. Louis, Mo.) in methanol in the presence of the surrogate, triheptadecanoin (Nu-Chek Prep, Elysian, Minn.). The reaction was conducted under mild heat (40° C.) and constant shaking and the resulting FAMEs extracted with heptane. Completion of the reaction was verified by recovery of the reacted heptadecanoate methyl-ester surrogate. The FAMEs extracts were analyzed by GC-FID using an Agilent 6890 Gas Chromatograph (Agilent Technologies, Santa Clara, Calif.) and a 15 m×0.25 mm×0.25 µm BPX 70 capillary column from SGE (Austin, Tex.). Each FAME peak was identified by its retention time and quantified by the injection of a rapeseed oil reference mix from Matreya LLC (Pleasant Gap, Pa.). The calibration standard contained individually added standards of DHA (C22:6), EPA (C20:5), DPA(n-6) (C22:5), γ-linolenoate (C18:3) and arachidonate methyl esters from Nu-Chek. Data analysis was performed using ChemStation4 software (Agilent).

DHA comprised 60% of the total LC-PUFA content in those $T_2$ seeds that contained LC-PUFA. Only the two novel LC-PUFAs, DHA and DPA (n-6), were detected in the $T_2$ soybean seeds. The fatty acids which are expected to be found in soybean seeds were detected at normal levels, except that total C18 fatty acids were proportionally lower due to the presence of LC-PUFAs. Two other fatty acids (γ-linolenic and arachidonic acids) were detected in these transgenic soybean seeds at a low level (less than 1% combined).

Molecular Confirmation of Plant Transformants.

Copy Number Analysis and Detection of Coding Region.

$T_0$ plants were identified and selected from the transformations described above. These transformants were further analyzed to identify plants which contained each of the transgene PTU expression cassettes. Hydrolysis probe assays, analogous to TAQMAN®, were performed to initially screen for and confirm the presence of the PFA1, PFA2, PFA3, HetI, SzACS2, and pat transgenes and the absence of the VirD2 *Agrobacterium* gene. Assays were deployed as previously described in International Patent Publication Nos. WO2013016546 and WO2011146524, herein incorporated by reference. The data generated from these quantitative PCR studies was used to determine the transgene presence and copy number. Events containing all of the PTUs were selected for advancement to $T_1$ plants.

Detection of PUFA Synthase Proteins in Canola and *Arabidopsis* Seed.

Quantitative Western blot methods were developed to detect PUFA synthase polypeptides from seed samples of canola and *Arabidopsis*. Antigens for full length PFA1 and PFA3 were recombinantly expressed with an N-terminal HIS tag and partially purified via Cobalt affinity chromatography. Antigens for the full length PFA2 did not contain a HIS tag, and were isolated from inclusion bodies. An N-terminal PFA2 fragment, and a PFA3 fragment that overlapped with a predicted ER domain, were also recombinantly expressed as antigens. All of these fragments were submitted as gel slices for polyclonal antibody production in rabbits. Antigens for full-length HetI were recombinantly expressed with an N-terminal 6× His tag in BL21(DE3) *Escherichia coli* cells (Invitrogen; Carlsbad, Calif.), and were highly purified via Cobalt affinity chromatography. Antigens were submitted as TBS buffered soluble proteins at a concentration of about 2 mg/mL for polyclonal production in rabbits. All antisera were purified by Protein G antibody affinity chromatography.

Recombinant reference standards for PFA1, PFA2, PFA3, and HetI were heterologously expressed and produced in Arctic Express (DE3) RIL (Invitrogen; Carlsbad, Calif.), and purified via His-ComAC purification. Protein concentrations were determined by densitometry using a BSA standard curve for in-gel quantitation with denaturing SDS-PAGE and Coomassie blue staining.

Seed samples were prepared for analysis by cracking dry *Arabidopsis* seed with two stainless steel beads in a Kleco Bead Beater™ (Garcia Machine, Visalia, Calif.), or by processing the delipidated cake that resulted from a bulk canola seed FAME analysis, as described above. Extraction buffer was added (50 mM Tris, 10 mM EDTA, 2% SDS) to the seed samples, and the tubes containing the samples and extraction buffer were rocked gently for 15-30 minutes. The samples were centrifuged for 30 minutes at 3,000×g. The supernatant was collected and used for analysis.

The amount of total soluble protein in the seed extract was determined using a Pierce 660 nm Protein Assay™ (Thermo Scientific, Rockford, Ill.). Samples were normalized to 1.55 mg/mL total soluble protein, and prepared in LDS sample buffer (Invitrogen, Carlsbad, Calif.) with 40 mM DTT for a normalized load of 20 μg total soluble protein per lane. Samples were electrophoresed in 3-8% Tris acetate gels (Invitrogen, Carlsbad, Calif.), and transferred to nitrocellulose membranes. Blots were blocked in blocking buffer and probed with antibodies against the different PUFA synthase polypeptides (PFA1, PFA2, and PFA3). An anti-rabbit fluorescent labeled secondary antibody, Goat Anti-Rabbit AF 633™ (Invitrogen, Carlsbad, Calif.) was used for detection. Blots were visualized on a Typhoon Trio Plus Fluorescent Imager™ (GE Healthcare, New Brunswick N.J.). The resulting SDS-PAGE Western blots of extracts from mature seed for $Arabidopsis$ $T_2$ seed, soybean $T_1$ seed, and canola $T_1$ seed produced bands at the appropriate size when probed with PFA1, PFA2, PFA3, and HetI specific antisera.

The SDS-PAGE Western blot detection of PUFA synthase polypeptides PFA1, PFA2, PFA3, and HetI in $T_1$ soybean seed extracts for event 101454[267]-26702.001 produced bands of the expected molecular weight.

Also, the SDS-PAGE Western blot detection of PUFA synthase polypeptides PFA1, PFA2, PFA3, and HetI in $T_1$ canola seed extracts for the following events: 6580[2]-016.Sx001; 6580[2]-017.Sx001; 6580[2]-017.Sx002; 6580[2]-018.Sx001; 6580[2]-019.Sx001; 6580[2]-020.Sx001; 6580[2]-021.Sx001; 6580[2]-021.Sx002; 6580[2]-024.Sx001; 6580[2]-039.Sx001; and 6580[2]-039.Sx002, produced bands of the expected molecular weight.

Next, the PUFA synthase specific proteins were quantified via SDS-PAGE Western blots with 5 point standard curves (100 ng, 50 ng, 25 ng, 12.5 ng and 6.25 ng) for each polypeptide. Table 2 and Table 3 summarize results for $Arabidopsis$ and canola, respectively.

TABLE 2

Summary of PUFA Synthase Polypeptide content in bulk $T_2$ $Arabidopsis$ seed.

| | Orientation | n | Min. ng PFA1/ μg TSP | Max. ng PFA1/ μg TSP | Min. ng PFA2/ μg TSP | Max. ng PFA2/ μg TSP |
|---|---|---|---|---|---|---|
| pDAB101454 | 1 | 10 | 1.84 | 4.77 | 0.00 | 2.63 |
| pDAB101496 | 1 | 11 | 0.92 | 15.56 | 0.00 | 0.94 |
| pDAB109525 | 1 | 22 | 2.54 | 13.02 | 1.80 | 6.16 |
| pDAB109584 | 1 | 22 | 3.35 | 8.06 | 3.01 | 9.46 |
| pDAB109588 | 1 | 22 | 0.25 | 6.34 | 0.59 | 5.08 |
| pDAB109591 | 2 | 22 | 0.73 | 5.70 | 2.08 | 9.46 |
| pDAB109592 | 2 | 22 | 2.64 | 5.89 | 3.49 | 9.46 |
| pDAB112200 | 3 | 31 | 0.25 | 8.33 | 0.00 | 4.38 |
| pDAB112201 | 3 | 30 | 0.25 | 7.41 | 0.00 | 0.82 |
| pDAB112203 | 3 | 29 | 0.25 | 7.17 | 0.00 | 1.23 |
| pDAB112205 | 3 | 38 | 0.00 | 7.36 | 0.00 | 8.18 |
| pDAB112209 | 3 | 17 | 0.00 | 1.66 | 0.00 | 2.36 |

| | Orientation | n | Min. ng PFA3/ μg TSP | Max. ng PFA3 μg TSP | Min. ng HetI/ μg TSP | Max. ng HetI/ μg TSP |
|---|---|---|---|---|---|---|
| pDAB101454 | 1 | 10 | 1.82 | 11.29 | | |
| pDAB101496 | 1 | 11 | 0.96 | 5.10 | | |
| pDAB109525 | 1 | 22 | 4.01 | 9.34 | | |
| pDAB109584 | 1 | 22 | 3.80 | 7.19 | 0.25 | 0.25 |
| pDAB109588 | 1 | 22 | 4.87 | 9.46 | 0.25 | 0.25 |
| pDAB109591 | 2 | 22 | 2.86 | 9.46 | 0.25 | 6.88 |
| pDAB109592 | 2 | 22 | 2.10 | 9.46 | 0.25 | 0.25 |
| pDAB112200 | 3 | 31 | 0.00 | 9.46 | 0.00 | 1.81 |
| pDAB112201 | 3 | 30 | 0.00 | 4.65 | 0.00 | 0.25 |
| pDAB112203 | 3 | 29 | 0.00 | 9.46 | 0.00 | 1.44 |
| pDAB112205 | 3 | 38 | 0.00 | 1.83 | 0.00 | 0.25 |
| pDAB112209 | 3 | 17 | 0.25 | 9.46 | 0.00 | 0.63 |

TABLE 3

Summary of PUFA Synthase Polypeptide content in bulk $T_1$ seed of canola events.

| | Orientation | n | Min. ng PFA1/ μg TSP | Max. ng PFA1/ μg TSP | Min. ng PFA2/ μg TSP | Max. ng PFA2/ μg TSP |
|---|---|---|---|---|---|---|
| pDAB101496 | 1 | 242 | 0.00 | 5.38 | 0.00 | 8.93 |
| pDAB109584 | 1 | 30 | 0.20 | 3.13 | 0.00 | 3.29 |
| pDAB109592 | 2 | 62 | 0.00 | 3.12 | 0.00 | 3.48 |
| pDAB107960 | 2 | 17 | 0.00 | 4.87 | 0.25 | 7.50 |

| | Orientation | n | Min. ng PFA3/ μg TSP | Max. ng PFA3/ μg TSP | Min. ng HetI/ μg TSP | Max. ng HetI/ μg TSP |
|---|---|---|---|---|---|---|
| pDAB101496 | 1 | 242 | 0.00 | 6.42 | 0.00 | 1.01 |
| pDAB109584 | 1 | 30 | 0.42 | 7.22 | 0.00 | 0.31 |
| pDAB109592 | 2 | 62 | 0.00 | 7.50 | 0.00 | 0.31 |
| pDAB107960 | 2 | 17 | 0.32 | 6.60 | 0.20 | 1.82 |

Figure 1A:
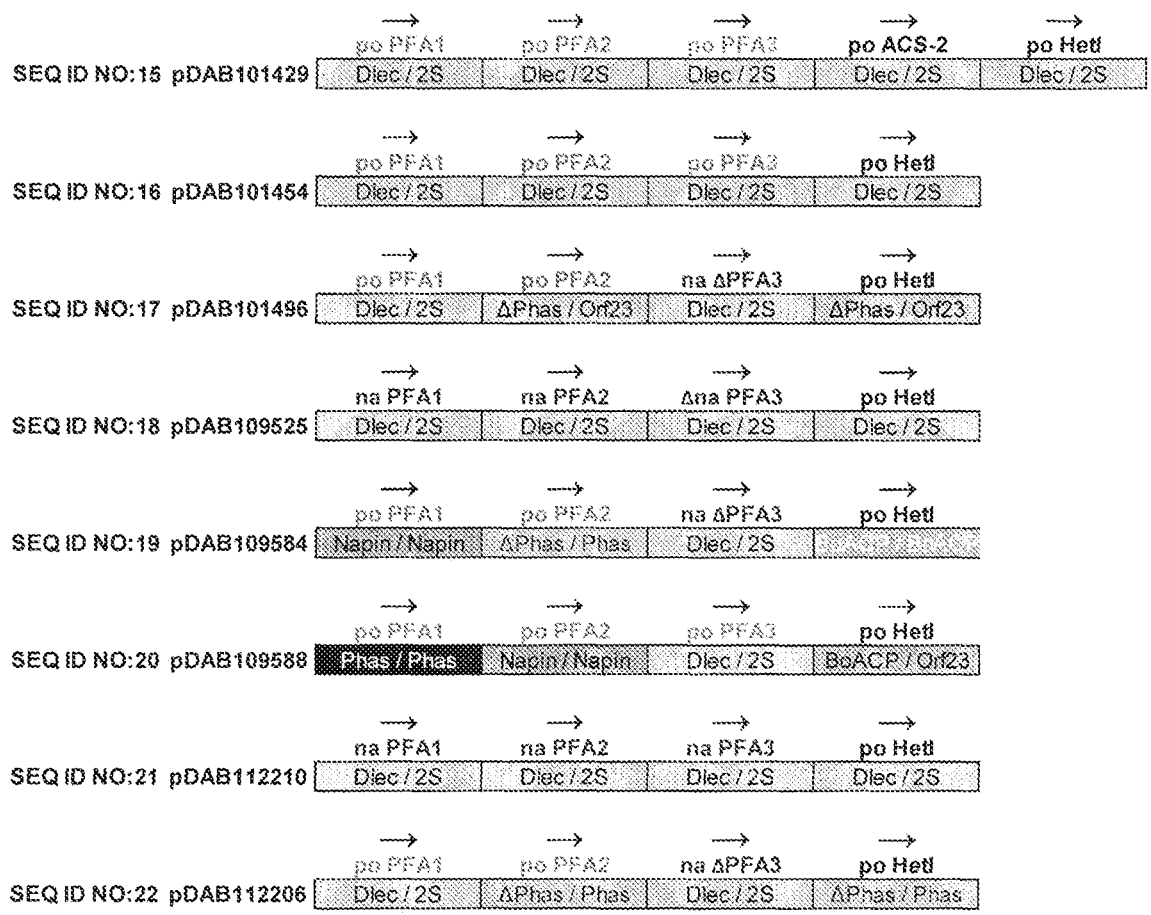
FIGS. 1a, 1b, and 1c include a summary of exemplary PUFA synthase constructs utilized in some embodiments. The direction of transcription is shown above each boxed PTU, the coding sequence is noted above each PTU, and the promoter/terminator combinations used are indicated.
Figure 1B:
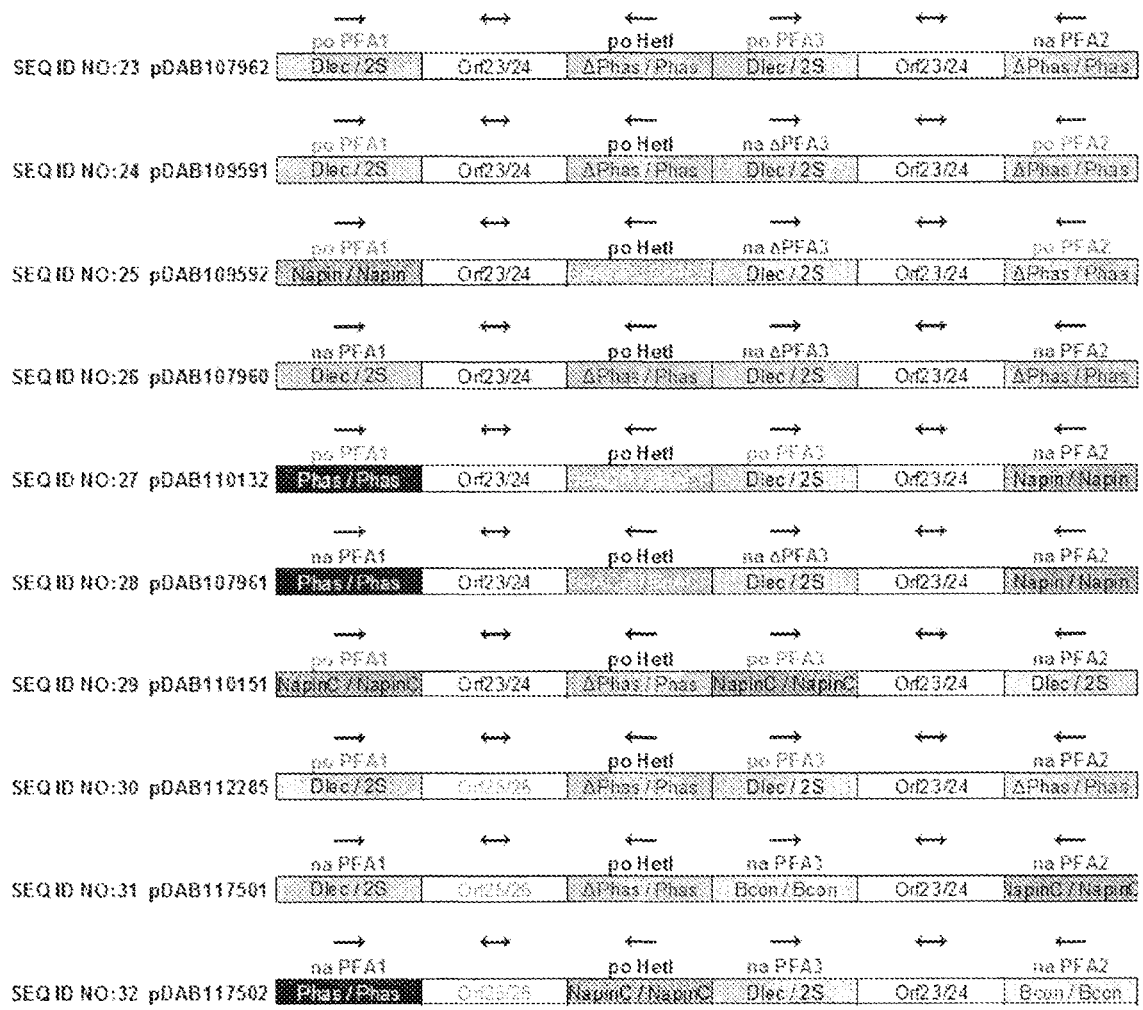
Figure 1C:
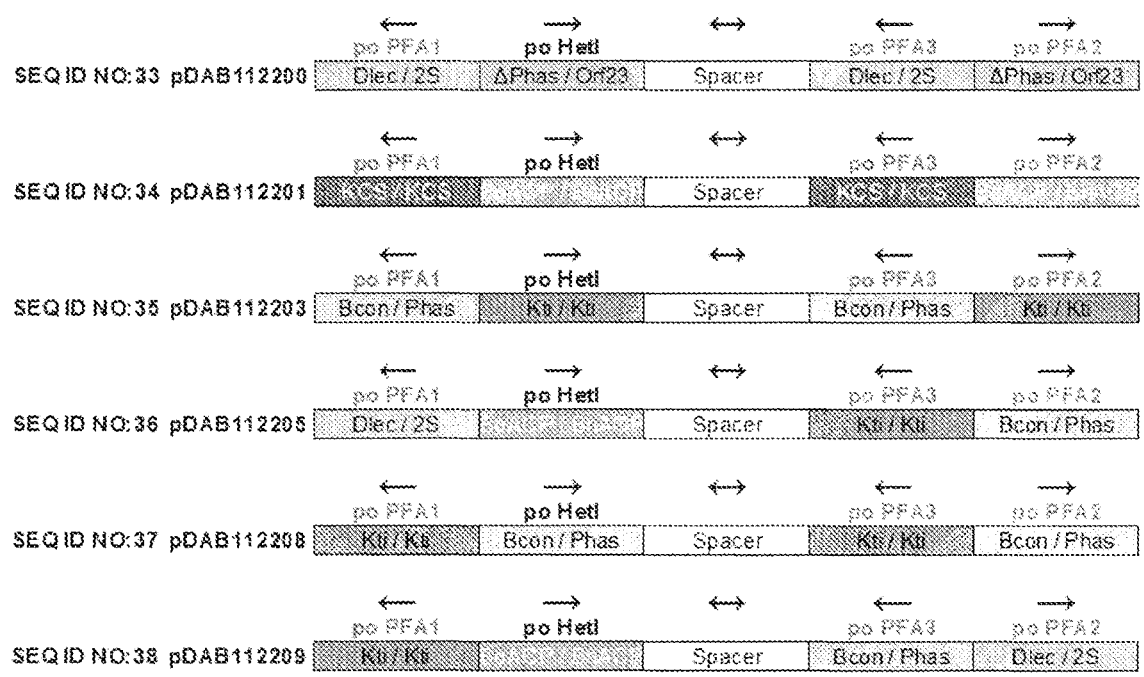
Figure 2:
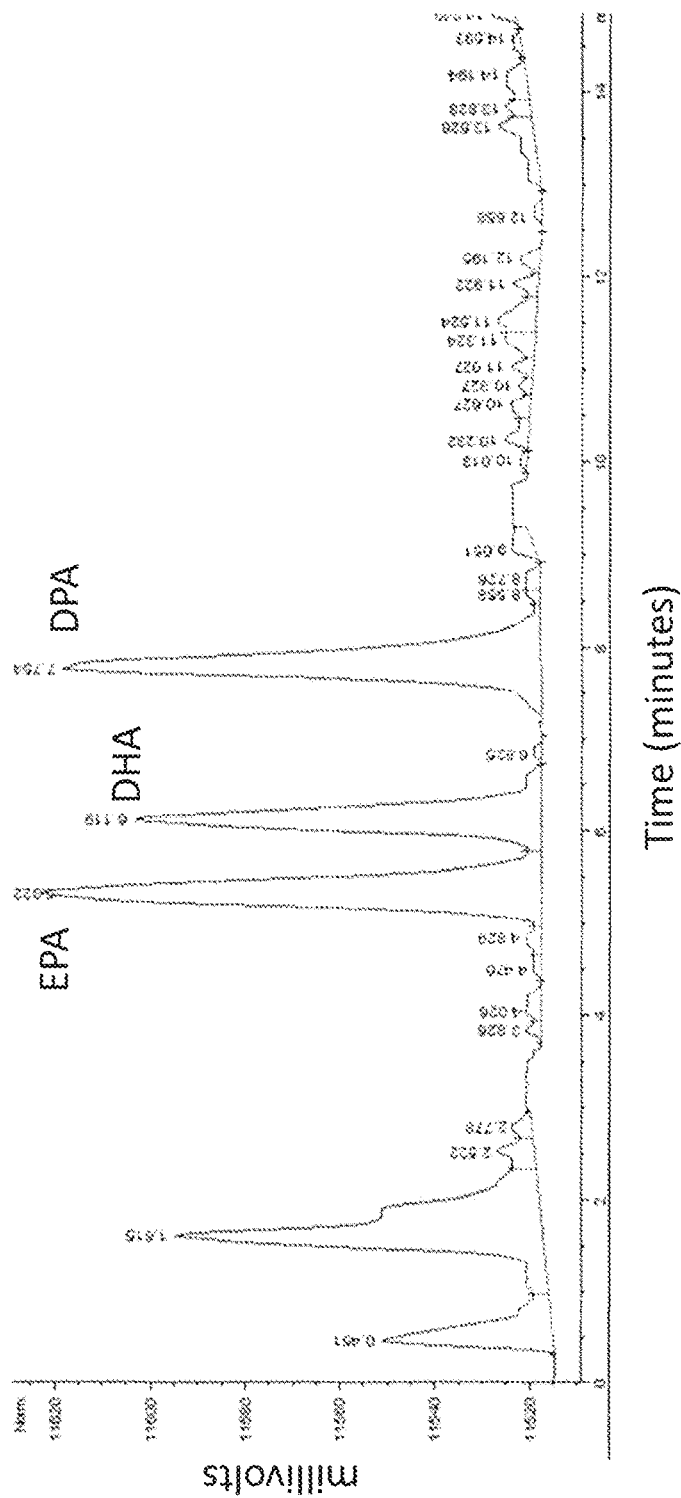
FIG. 2 includes a HPLC radiometric trace of $^{14}$C-labeled EPA, DHA, and DPA standards. Retention times for EPA and DHA are labeled at ~5.3 and ~6.1 minutes, respectively.
Figure 3:
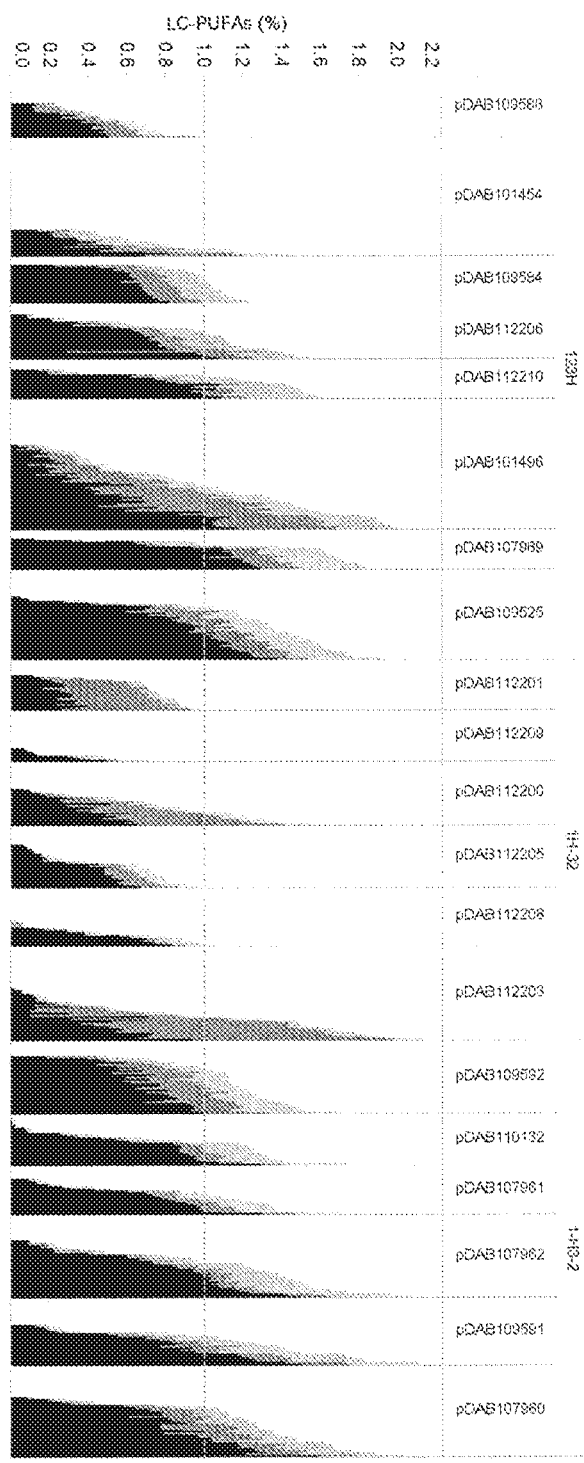
FIG. 3 includes a summary of LC-PUFA content in $T_2$ seeds of Arabidopsis events transformed with the PUFA synthase and HetI transgenes. Each vertical bar represents the LC-PUFA content from one Arabidopsis event; black=DHA, dark gray=EPA, light gray=DPA (n-6).

Example 3: LC-PUFA Production in $Arabidopsis$ Seeds Transformed with PUFA Synthase A summary of DHA and other LC-PUFA oil content obtained from the seed of transgenic $Arabidopsis$ $T_1$ events generated with constructs encoding PUFA synthase genes is shown in Table 4. DHA and EPA HPLC retention times were identified using authentic $^{14}C$-labeled standards. FIG. 2. Quantitation of PUFA's was performed using a 1-$^{14}C$-labeled DHA standard curve. The LC-PUFA content of each event analyzed is shown in FIG. 3. These data indicate that the type of construct PTU configuration and the usage of specific combinations of regulatory elements for expressing the PUFA synthase and HetI genes can be used to change the number of transgenic events obtained that produce LC-PUFA in $T_2$ $Arabidopsis$ seed.

TABLE 4

Summary of LC-PUFA content in $T_2$ seeds of *Arabidopsis* events transformed with the PUFA synthase and HetI transgenes and containing a single copy of the pat transgene.

| | Orientation | n | No. with LC-PUFA | No. with LC-PUFA >1%[1] | Avg. LC-PUFA content[2] | Max. total PUFAs[3] |
|---|---|---|---|---|---|---|
| pDAB101429 | 1 (containing HetI) | 129 | 15 (12%) | 1 (1%) | 0.05 | 1.55 |
| pDAB109588 | 1 | 37 | 21 (57%) | 1 (3%) | 0.33 | 1.04 |
| pDAB101454 | 1 | 72 | 16 (22%) | 5 (7%) | 0.18 | 1.43 |
| pDAB109584 | 1 | 28 | 23 (82%) | 14 (50%) | 0.83 | 1.24 |
| pDAB112206 | 1 | 34 | 27 (79%) | 16 (47%) | 0.76 | 1.56 |
| pDAB112210 | 1 | 24 | 18 (75%) | 13 (54%) | 0.89 | 1.61 |
| pDAB101496 | 1 | 80 | 52 (65%) | 27 (34%) | 0.68 | 2.02 |
| pDAB109525 | 1 | 55 | 38 (69%) | 33 (60%) | 0.89 | 1.91 |
| pDAB112201 | 3 | 31 | 22 (71%) | 0 (0%) | 0.50 | 0.98 |
| pDAB112209 | 3 | 17 | 6 (35%) | 0 (0%) | 0.12 | 0.71 |
| pDAB112208 | 3 | 13 | 4 (31%) | 0 (0%) | 0.12 | 0.74 |
| pDAB112200 | 3 | 39 | 23 (59%) | 9 (23%) | 0.48 | 1.53 |
| pDAB112205 | 3 | 38 | 27 (71%) | 0 (0%) | 0.36 | 0.99 |
| pDAB112203 | 3 | 31 | 19 (61%) | 9 (29%) | 0.60 | 2.14 |
| pDAB109592 | 2 | 45 | 36 (80%) | 28 (62%) | 0.92 | 1.70 |
| pDAB110132 | 2 | 31 | 23 (74%) | 14 (45%) | 0.73 | 1.75 |
| pDAB107961 | 2 | 30 | 22 (73%) | 13 (43%) | 0.69 | 1.73 |
| pDAB109591 | 2 | 41 | 25 (61%) | 18 (44%) | 0.74 | 2.12 |
| pDAB107962 | 2 | 51 | 36 (71%) | 21 (41%) | 0.78 | 2.06 |
| pDAB107960 | 2 | 56 | 37 (66%) | 30 (54%) | 0.82 | 2.02 |

| | Avg. DHA content | Max. DHA content | Avg. EPA content | Max. EPA content | Avg. n3/PUFA ratio[4] | Avg. EPA:DHA |
|---|---|---|---|---|---|---|
| pDAB101429 | 0.02 | 0.87 | 0.01 | 0.41 | 0.52 | 1:2.00 |
| pDAB109588 | 0.19 | 0.51 | 0.09 | 0.44 | 0.86 | 1:2.11 |
| pDAB101454 | 0.09 | 0.81 | 0.04 | 0.51 | 0.72 | 1:2.25 |
| pDAB109584 | 0.52 | 0.82 | 0.15 | 0.41 | 0.81 | 1:3.47 |
| pDAB112206 | 0.49 | 1.08 | 0.13 | 1.00 | 0.81 | 1:3.77 |
| pDAB112210 | 0.58 | 1.09 | 0.09 | 0.24 | 0.76 | 1:6.44 |
| pDAB101496 | 0.32 | 1.17 | 0.26 | 0.84 | 0.84 | 1:1.23 |
| pDAB109525 | 0.62 | 1.38 | 0.13 | 0.49 | 0.83 | 1:4.77 |
| pDAB112201 | 0.18 | 0.39 | 0.28 | 0.67 | 0.93 | 1.56:1 |
| pDAB112209 | 0.09 | 0.49 | 0.01 | 0.07 | 0.86 | 1:9.00 |
| pDAB112208 | 0.09 | 0.56 | 0.02 | 0.12 | 0.91 | 1:4.50 |
| pDAB112200 | 0.22 | 0.65 | 0.20 | 0.77 | 0.87 | 1:1.10 |
| pDAB112205 | 0.25 | 0.67 | 0.06 | 0.19 | 0.89 | 1:4.17 |
| pDAB112203 | 0.24 | 0.94 | 0.30 | 1.17 | 0.90 | 1.25:1 |
| pDAB109592 | 0.56 | 1.00 | 0.20 | 0.48 | 0.83 | 1:2.80 |
| pDAB110132 | 0.52 | 1.29 | 0.07 | 0.16 | 0.78 | 1:7.43 |
| pDAB107961 | 0.50 | 1.30 | 0.08 | 0.19 | 0.82 | 1:6.25 |
| pDAB109591 | 0.49 | 1.50 | 0.10 | 0.42 | 0.79 | 1:4.90 |
| pDAB107962 | 0.56 | 1.50 | 0.07 | 0.20 | 0.81 | 1:8.00 |
| pDAB107960 | 0.56 | 1.59 | 0.13 | 0.42 | 0.85 | 1:4.31 |

[1]Number of events with LC-PUFA content >1% of total seed FAMEs with percentage of total events in parentheses
[2]Average total LC-PUFA content (DHA (n-3) + EPA(n-3) + DPA (n-6)) as % of total seed FAMEs
[3]Maximum total LC-PUFA content of all T2 seed samples analyzed as % of total FAMEs
[4]Average n-3 LC-PUFA (DHA + EPA)/Total LC-PUFA content across all LC-PUFA-producing events For example, only 22% of all single copy events for pDAB101454 produced DHA, whereas 65% of pDAB101496 events and 79% of pDAB112206 events produced DHA. As compared to pDAB101454, the pDAB101496 binary vector contains diversified regulatory elements. Likewise, as compared to pDAB101454, the pDAB112206 construct contains both diversified regulatory elements and an altered PTU configuration. Another construct, pDAB109584, contains additional regulatory element diversification, and also contains the native coding sequence version of the PFA3 gene, rather than a "plant-optimized" version. In this case, 82% of all single copy events produced LC-PUFAs.

Further modifications of regulatory elements, construct configuration, and use of native gene sequences in the second orientation PTU configuration resulted in constructs that produced transgenic *Arabidopsis* plants with 61-80% of all single copy events producing LC-PUFAs. The second orientation PTU configuration constructs also produced transgenic plants with a higher proportion of events (41-62%) with LC-PUFA contents of >1% in $T_2$ *Arabidopsis* seed. The presence of native (vs. plant-optimized) PUFA synthase gene sequences also improved the proportion of >1% LC-PUFA events. For example, pDAB109525 and pDAB112210 containing native gene sequences had 60% and 54%, respectively, of single copy events making >1% LC-PUFA. In contrast, pDAB101454 that comprises all plant-optimized genes (in the same format and using the same regulatory elements) had only 5% of events making >1% LC-PUFA.

The maximum LC-PUFA content of $T_2$ seed from events using the various constructs ranged from 0.71-2.14%. The maximum DHA content ranged from 0.39-1.59%. The highest levels of DHA were obtained with constructs in the second orientation PTU configuration, for example, pDAB109591, pDAB107962 and pDAB107960. These constructs contained two different promoter/terminator combinations to drive the four transgenes, and either one or three native PUFA synthase genes.

The maximum EPA content ranged from 0-1.17% across all the constructs and events generated. Constructs pDAB112203 (third orientation PTU configuration), pDAB112200 (third orientation PTU configuration), pDAB112201 (third orientation PTU configuration) and pDAB101496 (first orientation PTU configuration) were effective at making relatively high levels of EPA compared to other constructs. The LC-PUFA-producing events from these constructs contained a relatively high proportion of EPA (39-56% of LC-PUFAs) in comparison to DHA (37-45% of LC-PUFAs), whereas other constructs typically contained a lower proportion of EPA (9-27% of LC-PUFAs), and a higher proportion of DHA (60-76% of LC-PUFAs).

These data show that the selection of construct configuration and gene regulatory elements results in improved efficiency for producing both ω-3 LC-PUFAs, DHA and EPA, in *Arabidopsis* seeds, and that the selection of construct configuration and gene regulatory elements can be used to increase the efficiency for producing both ω-3 LC-PUFAs, DHA and EPA, in crop plants.

*Arabidopsis* $T_3$ Seed.

Figure 4:
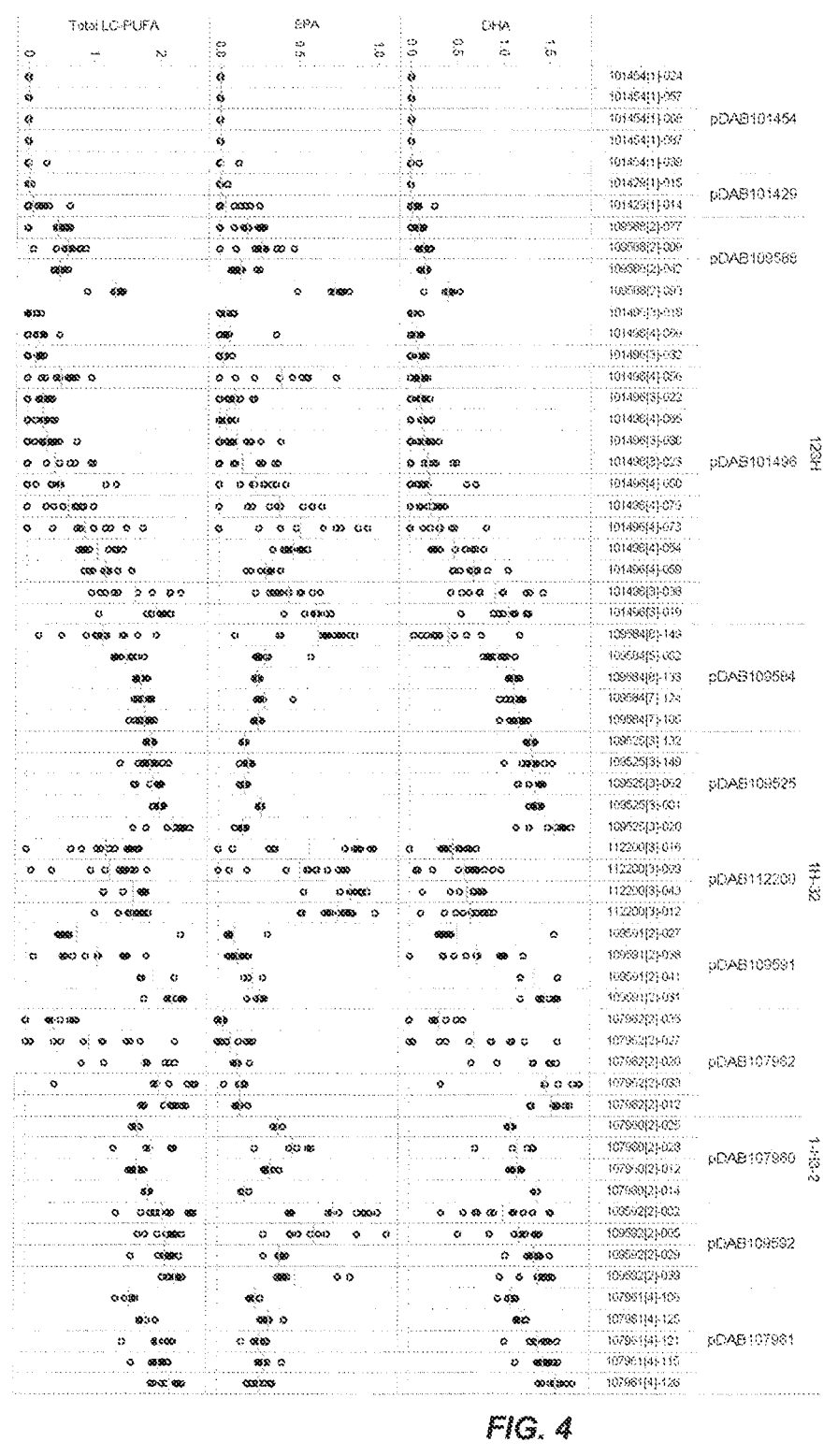

The $T_2$ seed from high LC-PUFA producing *Arabidopsis* events were planted and leaf tissue from the $T_2$ plants sampled via quantitative PCR reactions for the pat gene and other transgenes. Plants containing two copies of the transgenes (i.e., homozygotes) were identified and grown to maturity. The resulting $T_3$ seed was harvested and analyzed for LC-PUFA content. Constructs pDAB101454 and pDAB101429 that contained repeated promoter/terminator expression elements and used all "plant-optimized" PUFA synthase gene sequences exhibited very poor stability of the LC-PUFA trait in the subsequent $T_3$ seed generation, with little or no LC-PUFAs detected in the $T_3$ seed progeny. Other events transformed with constructs having different PTU configurations and/or diversified expression elements (pDAB109588, pDAB101496) produced transgenic *Arabidopsis* lines with LC-PUFA detectable to varying levels in the $T_3$ seed generation (Table 5, FIG. 4). Lines from a construct with completely diversified promoter/terminator combinations (pDAB109584) or with entirely native PUFA synthase gene sequences (pDAB109525) in the first orientation PTU format showed very good stability into the $T_3$ seed generation. Combining the use of diversified promoter/terminator combinations and/or use of one or three native PUFA synthase sequences in the second orientation or third orientation PTU formats also led to consistent stability into the $T_3$ seed generation (for example, for constructs pDAB107960 and pDAB107961). This resulted in individual $T_3$ homozygous seed lines containing up to 1.77% DHA, up to 1.1% EPA, and up to 2.57% total LC-PUFAs.

TABLE 5

LC-PUFA analysis of $T_3$ seed progeny from selected transgenic *Arabidopsis* DHA-producing $T_2$ lines.

| | Orientation | Event ID. | DHA content | EPA content | Total LC-PUFA content | EPA:DHA |
|---|---|---|---|---|---|---|
| pDAB101496 | 1 | 101496[3]-019 | 1.09 | 0.61 | 1.97 | 1:1.79 |
| pDAB101496 | 1 | 101496[3]-023 | 1.01 | 0.27 | 1.61 | 1:3.74 |
| pDAB101496 | 1 | 101496[4]-054 | 0.87 | 0.49 | 1.66 | 1:1.78 |
| pDAB109525 | 1 | 109525[3]-001 | 1.23 | 0.21 | 1.73 | 1:5.86 |
| pDAB109525 | 1 | 109525[3]-020 | 1.27 | 0.15 | 1.77 | 1:8.47 |
| pDAB109525 | 1 | 109525[3]-062 | 1.24 | 0.18 | 1.73 | 1:6.89 |
| pDAB109584 | 1 | 109584[7]-105 | 0.76 | 0.16 | 1.15 | 1:4.75 |
| pDAB109584 | 1 | 109584[7]-124 | 0.82 | 0.18 | 1.24 | 1:4.56 |
| pDAB109584 | 1 | 109584[8]-133 | 0.73 | 0.16 | 1.13 | 1:4.56 |
| pDAB109588 | 1 | 109588[2]-009 | 0.48 | 0.18 | 0.75 | 1:2.67 |
| pDAB109588 | 1 | 109588[2]-042 | 0.49 | 0.16 | 0.77 | 1:3.06 |
| pDAB109588 | 1 | 109588[2]-093 | 0.51 | 0.44 | 1.04 | 1:1.16 |
| pDAB112200 | 3 | 112200[3]-009 | 0.61 | 0.57 | 1.33 | 1:1.07 |
| pDAB112200 | 3 | 112200[3]-012 | 0.54 | 0.53 | 1.21 | 1:1.02 |
| pDAB112200 | 3 | 112200[3]-043 | 0.59 | 0.68 | 1.39 | 1.15:1 |
| pDAB107960 | 2 | 107960[2]-012 | 0.97 | 0.26 | 1.41 | 1:3.73 |
| pDAB107960 | 2 | 107960[2]-014 | 1.31 | 0.19 | 1.80 | 1:6.89 |
| pDAB107960 | 2 | 107960[2]-028 | 0.79 | 0.37 | 1.36 | 1:2.14 |
| pDAB107961 | 2 | 107961[4]-115 | 1.10 | 0.18 | 1.52 | 1:6.11 |
| pDAB107961 | 2 | 107961[4]-121 | 0.94 | 0.12 | 1.33 | 1:7.83 |
| pDAB107961 | 2 | 107961[4]-126 | 1.30 | 0.17 | 1.73 | 1:7.65 |
| pDAB107962 | 2 | 107962[2]-012 | 1.23 | 0.11 | 1.74 | 1:11.18 |
| pDAB107962 | 2 | 107962[2]-020 | 1.18 | 0.10 | 1.65 | 1:11.80 |
| pDAB107962 | 2 | 107962[2]-033 | 1.41 | 0.14 | 1.95 | 1:10.07 |
| pDAB109591 | 2 | 109591[2]-027 | 1.42 | 0.30 | 2.10 | 1:4.73 |
| pDAB109591 | 2 | 109591[2]-031 | 1.27 | 0.21 | 1.85 | 1:6.05 |
| pDAB109591 | 2 | 109591[2]-041 | 1.50 | 0.25 | 2.12 | 1:6.00 |
| pDAB109592 | 2 | 109592[2]-005 | 0.95 | 0.25 | 1.48 | 1:3.80 |
| pDAB109592 | 2 | 109592[2]-029 | 0.97 | 0.25 | 1.51 | 1:3.88 |
| pDAB109592 | 2 | 109592[2]-039 | 0.95 | 0.25 | 1.46 | 1:3.80 |

| Event ID. | No. $T_3$ progeny analyzed | Avg. DHA content | Avg. EPA content | Avg. Total LC-PUFA content | Avg. EPA:DPA |
|---|---|---|---|---|---|
| 101496[3]-019 | 10 | 1.07 (0.55-1.29) | 0.61 (0.41-0.71) | 1.94 (1.09-2.19) | 1:1.75 |
| 101496[3]-023 | 10 | 0.18 (0-0.50) | 0.14 (0-0.37) | 0.41 (0-1.00) | 1:1.29 |

TABLE 5-continued

LC-PUFA analysis of T₃ seed progeny from selected transgenic
Arabidopsis DHA-producing T₂ lines.

| | | | | | |
|---|---|---|---|---|---|
| 101496[4]-054 | 10 | 0.46 (0.23-0.8) | 0.46 (0.34-0.56) | 1.06 (0.79-1.46) | 1:1.00 |
| 109525[3]-001 | 12 | 1.37 (1.29-1.42) | 0.26 (0.25-0.27) | 2.02 (1.91-2.08) | 1:5.27 |
| 109525[3]-020 | 11 | 1.55 (1.15-1.74) | 0.15 (0.10-0.17) | 2.21 (1.61-2.47) | 1:10.33 |
| 109525[3]-062 | 8 | 1.34 (1.17-1.44) | 0.16 (0.13-0.18) | 1.91 (1.62-2.05) | 1:8.38 |
| 109584[7]-105 | 11 | 1.17 (0.97-1.28) | 0.24 (0.22-0.27) | 1.78 (1.55-1.94) | 1:4.88 |
| 109584[7]-124 | 9 | 1.13 (0.97-1.23) | 0.29 (0.24-0.47) | 1.77 (1.63-1.9) | 1:3.90 |
| 109584[8]-133 | 11 | 1.12 (1.07-1.19) | 0.24 (0.23-0.26) | 1.73 (1.65-1.84) | 1:4.67 |
| 109588[2]-009 | 12 | 0.13 (0.08-0.22) | 0.26 (0-0.47) | 0.61 (0.08-0.88) | 2:1 |
| 109588[2]-042 | 12 | 0.16 (0.10-0.18) | 0.13 (0.07-0.25) | 0.48 (0.39-0.61) | 1:1.23 |
| 109588[2]-093 | 9 | 0.40 (0.14-0.53) | 0.73 (0.49-0.82) | 1.33 (0.90-1.44) | 1.83:1 |
| 112200[3]-009 | 12 | 0.59 (0.07-0.99) | 0.51 (0-0.81) | 1.25 (0.07-1.83) | 1:1.16 |
| 112200[3]-012 | 12 | 0.65 (0.12-0.91) | 0.75 (0.52-0.99) | 1.60 (1.04-1.85) | 1.15:1 |
| 112200[3]-043 | 9 | 0.61 (0.14-0.8) | 0.83 (0.54-0.94) | 1.61 (1.17-1.82) | 1.36:1 |
| 107960[2]-012 | 12 | 1.16 (1.08-1.22) | 0.32 (0.29-0.39) | 1.69 (1.56-1.80) | 1:3.63 |
| 107960[2]-014 | 3 | 1.37 (1.35-1.39) | 0.17 (0.15-0.2) | 1.85 (1.81-1.89) | 1:8.06 |
| 107960[2]-028 | 5 | 1.16 (0.71-1.34) | 0.47 (0.23-0.59) | 1.90 (1.33-2.24) | 1:2.47 |
| 107961[4]-115 | 10 | 1.45 (1.15-1.61) | 0.29 (0.26-0.41) | 2.02 (1.61-2.18) | 1:5.00 |
| 107961[4]-121 | 11 | 1.38 (1.03-1.6) | 0.26 (0.15-0.31) | 2.01 (1.47-2.24) | 1:5.31 |
| 107961[4]-126 | 8 | 1.59 (1.4-1.77) | 0.26 (0.19-0.35) | 2.18 (1.91-2.38) | 1:6.12 |
| 107962[2]-012 | 10 | 1.53 (1.31-1.73) | 0.14 (0.11-0.19) | 2.12 (1.75-2.43) | 1:10.93 |
| 107962[2]-020 | 9 | 1.29 (0.67-1.59) | 0.12 (0.1-0.2) | 1.77 (0.85-2.26) | 1:10.75 |
| 107962[2]-033 | 7 | 1.47 (0.34-1.84) | 0.14 (0.04-0.17) | 2.02 (0.44-2.57) | 1:10.50 |
| 109591[2]-027 | 9 | 0.50 (0.31-1.56) | 0.10 (0.06-0.31) | 0.76 (0.49-2.34) | 1:5.00 |
| 109591[2]-031 | 9 | 1.46 (1.2-1.6) | 0.26 (0.18-0.29) | 2.21 (1.79-2.39) | 1:5.62 |
| 109591[2]-041 | 3 | 1.33 (1.2-1.6) | 0.21 (0.16-0.28) | 1.91 (1.73-2.25) | 1:6.33 |
| 109592[2]-005 | 10 | 1.18 (0.53-1.41) | 0.61 (0.29-1.07) | 2.13 (1.71-2.37) | 1:1.93 |
| 109592[2]-029 | 10 | 1.35 (1.04-1.52) | 0.39 (0.29-0.43) | 2.11 (1.6-2.33) | 1:3.46 |
| 109592[2]-039 | 10 | 1.38 (0.98-1.55) | 0.49 (0.38-0.84) | 2.26 (2.08-2.38) | 1:2.82 |

Total LC-PUFA, DHA and EPA contents are % of total FAMEs
1. T3 seed bulks from 5-20 individual homozygous plants were analyzed The complete seed fatty acid profile for exemplary individual Arabidopsis T₃ lines that are homozygous for the DHA-producing transgenes is shown in Table 6, in comparison with the average lipid profile for the T₃ sibling nulls. The production of LC-PUFAs driven by PUFA synthase was associated with reduction in the content of native elongated fatty acids, particularly eicosenoic acid (22:1), and slight increases in oleic (18:1) and linoleic acid (18:2) content. There was no significant change in the content of saturated fatty acids, palmitic (16:0) and stearic acid (18:0).

TABLE 6

Fatty acid profiles of homozygous T₃ seeds of Arabidopsis events
transformed with the PUFA synthase and HetI transgenes.

| | Event | C14:0 | C16:0 | C16:1 | C18:0 | C18:1 n9 | C18:1 n7 |
|---|---|---|---|---|---|---|---|
| pDAB109525 | 109525[3]-020.Sx001.Sx020 | 0.1 | 7.5 | 0.2 | 3.8 | 16.7 | 1.1 |
| pDAB107961 | 107961[4]-126.Sx001.Sx050 | 0.1 | 7.7 | 0.3 | 3.9 | 21.3 | 1.6 |
| pDAB107962 | 107962[2]-033.Sx001.Sx033 | 0.1 | 8.0 | 0.4 | 3.9 | 20.9 | 1.7 |
| pDAB109592 | 109592[2]-002.Sx001.Sx009 | 0.1 | 7.9 | 0.3 | 3.3 | 17.4 | 1.5 |
| pDAB112200 | 112200[3]-012.Sx001.Sx054 | 0.0 | 7.5 | 0.3 | 3.3 | 14.7 | 1.3 |
| | Sib null average | 0.1 | 7.4 | 0.3 | 3.3 | 13.9 | 1.5 |

| Event | C18:2 | C18:3 | C20:0 | C20:1 | C20:2 | C22:0 | C22:1 | C20:5 EPA |
|---|---|---|---|---|---|---|---|---|
| 109525[3]-020.Sx001.Sx020 | 31.6 | 19.0 | 1.7 | 13.6 | 1.2 | 0.3 | 0.6 | 0.2 |
| 107961[4]-126.Sx001.Sx050 | 31.4 | 17.3 | 1.4 | 10.8 | 0.9 | 0.2 | 0.4 | 0.2 |
| 107962[2]-033.Sx001.Sx033 | 30.8 | 16.9 | 1.4 | 11.5 | 0.9 | 0.2 | 0.5 | 0.2 |
| 109592[2]-002.Sx001.Sx009 | 31.7 | 16.3 | 1.7 | 15.2 | 1.5 | 0.3 | 0.9 | 1.0 |
| 112200[3]-012.Sx001.Sx054 | 29.4 | 19.5 | 2.2 | 16.9 | 1.6 | 0.3 | 1.1 | 1.0 |
| Sib null average | 28.4 | 18.0 | 2.4 | 20.1 | 1.7 | 0.5 | 1.9 | 0.0 |

| Event | C24:0 | C22:5 DPA | C22:6 DHA | LC-PUFAs | EPA + DHA | N3/LC-PUFAs |
|---|---|---|---|---|---|---|
| 109525[3]-020.Sx001.Sx020 | 0.2 | 0.6 | 1.7 | 2.5 | 1.9 | 0.78 |
| 107961[4]-126.Sx001.Sx050 | 0.1 | 0.4 | 1.8 | 2.4 | 2.0 | 0.84 |
| 107962[2]-033.Sx001.Sx033 | 0.2 | 0.6 | 1.8 | 2.6 | 2.0 | 0.79 |
| 109592[2]-002.Sx001.Sx009 | 0.2 | 0.2 | 0.6 | 1.8 | 1.6 | 0.91 |
| 112200[3]-012.Sx001.Sx054 | 0.1 | 0.2 | 0.6 | 1.7 | 1.6 | 0.89 |
| Sib null average | 0.3 | 0.0 | 0.0 | 0.0 | 0.0 | |

TABLE 6-continued

Fatty acid profiles of homozygous $T_3$ seeds of *Arabidopsis* events transformed with the PUFA synthase and HetI transgenes.

| Event | EPA:DHA | DPA:DHA |
|---|---|---|
| 109525[3]-020.Sx001.Sx020 | 1:8.50 | 1:2.83 |
| 107961[4]-126.Sx001.Sx050 | 1:9.00 | 1:4.50 |
| 107962[2]-033.Sx001.Sx033 | 1:9.00 | 1:3.00 |
| 109592[2]-002.Sx001.Sx009 | 1.67:1 | 1:3.00 |
| 112200[3]-012.Sx001.Sx054 | 1.67:1 | 1:3.00 |
| Sib null average | | |

Selected high DHA-producing homozygous $T_3$ lines were planted, and the $T_4$ seed from these plants was analyzed. Ten lines from pDAB109591, pDAB109584, pDAB109525, pDAB109592, pDAB107960, and pDAB107961 transformations were analyzed. These lines continued to produce DHA (up to 1.85%) and EPA (up to 1.00%) in the $T_4$ seed generation, indicating the stable transmission of the (0-3 LC-PUFA trait through three selfed seed generations.

Example 4: LC-PUFA Production in Canola Seeds Transformed with *Schizochytrium* PUFA Synthase Transgenic canola were produced with the binary constructs pDAB101496, pDAB109584, pDAB109592, pDAB107960, pDAB107961, pDAB107962 and pDAB117501, (all containing the PUFA synthase genes PFA1, PFA2, PFA3, and the *Nostoc* PPTase NoHetI), and confirmed to contain a copy of the T-strand transgene via molecular confirmation.

$T_1$ seed was harvested from individual $T_0$ transgenic canola plants, and a bulk seed sample of approximately 10 seeds from each $T_1$ seed sample was analyzed for LC-PUFA content as previously described.

Of the $T_1$ samples analyzed for each construct, a high proportion (81-93%) contained LC-PUFAs. Table 7. The maximum DHA content observed in the canola $T_1$ seed samples was 3.04% for pDAB107960. The maximum EPA content observed was 1.97% for pDAB101496. The maximum combined ω-3 LC-PUFA content (DHA+EPA) was 4.20% for pDAB107960.

TABLE 7

Summary of LC-PUFA content in $T_1$ seeds of canola events transformed with the PUFA synthase and HetI transgenes.

| | Orientation | n | No. $T_1$ with LC-PUFA | Avg. DHA content | Max. DHA content | Avg. EPA content | Max. EPA content |
|---|---|---|---|---|---|---|---|
| pDAB101496 | 1 | 169 | 141 (83%) | 0.77 | 2.91 | 0.28 | 1.97 |
| pDAB109584 | 1 | 28 | 26 (93%) | 0.23 | 0.56 | 0.21 | 0.64 |
| pDAB109592 | 2 | 31 | 28 (90%) | 0.31 | 1.4 | 0.16 | 0.33 |
| pDAB107960 | 2 | 31 | 26 (84%) | 1.16 | 3.04 | 0.31 | 1.16 |
| pDAB107961 | 2 | 24 | 21 (88%) | 0.48 | 1.50 | 0.21 | 0.59 |
| pDAB107962 | 2 | 18 | 15 (83%) | 0.91 | 1.82 | 0.15 | 0.33 |
| pDAB117501 | 2 | 16 | 13 (81%) | 1.28 | 2.43 | 0.33 | 0.56 |

| | Avg. DHA + EPA content | Max. DHA + EPA content | Avg. Total LC-PUFAs | Max. Total LC-PUFAs | N3/PUFA Ratio | DHA/EPA Ratio |
|---|---|---|---|---|---|---|
| pDAB101496 | 1.06 | 3.91 | 1.26 | 4.51 | 0.84 | 2.74 |
| pDAB109584 | 0.40 | 0.82 | 0.45 | 0.97 | 0.86 | 1.11 |
| pDAB109592 | 0.52 | 1.71 | 0.67 | 2.80 | 0.79 | 1.91 |
| pDAB107960 | 1.47 | 4.20 | 2.01 | 6.18 | 0.76 | 3.76 |
| pDAB107961 | 0.69 | 2.09 | 1.04 | 3.20 | 0.62 | 2.28 |
| pDAB107962 | 1.06 | 2.10 | 1.68 | 3.49 | 0.66 | 5.90 |
| pDAB117501 | 1.61 | 2.99 | 2.69 | 4.89 | 0.62 | 3.89 |

To obtain an early indication of transgenic trait segregation, 48 seeds from selected $T_1$ seed samples were analyzed for LC-PUFA content. Events with T-DNA insertion(s) at a single locus would be expected to give approximately 25% null seeds by Mendelian segregation. Of the 42 $T_1$ seed samples that were analyzed from the pDAB101496 events, 24 were found to have between 12 and 35% of seeds with no LC-PUFA (the average proportion of null seeds was 24% across all 24 samples. Table 8. Single canola $T_1$ seeds were detected with up to 5.41% DHA, up to 3.72% EPA, and with up to 7.33% combined ω-3 LC-PUFA (DHA+EPA).

TABLE 8

LC-PUFA content of homozygous $T_2$ canola seed from transgenic events transformed with pDAB101496.

| Event | Seed Sample | n | Avg. DHA content | Avg. EPA content | Avg. EPA + DHA content | Avg. N3/PUFAs |
|---|---|---|---|---|---|---|
| 101496[26]-293.Sx001 | T1 | | 1.23 | 0.25 | 1.49 | 78% |
| | Homo T2 | 9 | 2.31 (1.99-2.55) | 0.52 (0.46-0.57) | 2.83 (2.45-3.08) | 80% |
| 101496[26]-333.Sx001 | T1 | | 1.68 | 0.51 | 2.19 | 83% |
| | Homo T2 | 10 | 2.88 (2.61-3.14) | 0.99 (0.74-1.27) | 3.87 (3.37-4.2) | 84% |
| 101496[6]-274.Sx001 | T1 | | 1.28 | 0.41 | 1.70 | 82% |
| | Homo T2 | 10 | 2.68 (2.50-2.93) | 1.30 (1.03-1.44) | 3.99 (3.72-4.35) | 86% |
| 101496[7]-357.Sx001 | T1 | | 1.68 | 0.72 | 2.40 | 83% |
| | Homo T2 | 10 | 2.54 (2.35-2.86) | 0.85 (0.71-1.04) | 3.39 (3.2-3.61) | 84% |
| 6580[1]-035.Sx001 | T1 | | 1.81 | 0.61 | 2.42 | 89% |
| | Homo T2 | 10 | 3.20 (2.79-3.41) | 1.42 (1.34-1.52) | 4.62 (4.2-4.82) | 87% |
| 6580[1]-035.Sx002 | T1 | | 2.12 | 0.61 | 2.73 | 88% |
| | Homo T2 | 23 | 3.26 (2.91-3.67) | 1.32 (1.1-1.58) | 4.58 (4.31-4.96) | 86% |
| 6580[1]-052.Sx001 | T1 | | 1.35 | 0.47 | 1.82 | 85% |
| | Homo T2 | 9 | 2.52 (2.39-2.68) | 0.94 (0.73-1.21) | 3.46 (3.19-3.71) | 84% |
| 6580[1]-057.Sx002 | T1 | | 1.41 | 0.50 | 1.91 | 87% |
| | Homo T2 | 10 | 2.71 (2.34-3.04) | 0.95 (0.49-1.28) | 3.66 (2.84-4.02) | 85% |
| 6580[1]-073.Sx001 | T1 | | 0.78 | 0.48 | 1.26 | 89% |
| | Homo T2 | 12 | 1.30 (0.81-1.65) | 0.89 (0.5-1.58) | 2.20 (1.4-2.95) | 88% |
| 6580[2]-093.Sx001 | T1 | | 1.70 | 0.47 | 2.17 | 81% |
| | Homo T2 | 10 | 3.00 (2.58-3.28) | 1.07 (0.98-1.18) | 4.07 (3.76-4.33) | 84% |

| Event | Seed Sample | Avg. EPA:DHA |
|---|---|---|
| 101496[26]-293.Sx001 | T1 | 1:4.92 |
| | Homo T2 | 1:4.44 |
| 101496[26]-333.Sx001 | T1 | 1:3.29 |
| | Homo T2 | 1:2.91 |
| 101496[6]-274.Sx001 | T1 | 1:3.12 |
| | Homo T2 | 1:2.06 |
| 101496[7]-357.Sx001 | T1 | 1:2.33 |
| | Homo T2 | 1:2.99 |
| 6580[1]-035.Sx001 | T1 | 1:2.97 |
| | Homo T2 | 1:2.25 |
| 6580[1]-035.Sx002 | T1 | 1:3.48 |
| | Homo T2 | 1:2.47 |
| 6580[1]-052.Sx001 | T1 | 1:2.87 |
| | Homo T2 | 1:2.68 |
| 6580[1]-057.Sx002 | T1 | 1:2.82 |
| | Homo T2 | 1:2.85 |
| 6580[1]-073.Sx001 | T1 | 1:1.63 |
| | Homo T2 | 1:1.46 |
| 6580[2]-093.Sx001 | T1 | 1:3.62 |
| | Homo T2 | 1:2.80 |

Selected $T_1$ canola seed samples were planted in the greenhouse to generate about 60-75 $T_1$ plants. Leaf samples were taken from the seedlings at the 4-5 leaf stage for DNA analysis to determine the transgene copy number in each $T_1$ segregant plant. The copy number analysis was performed by hydrolysis probe assays of the transgenes using the protocol described above. From these analyses, plants that were homozygous, heterozygous, and null for the transgenes were identified. Southern analysis was performed on genomic DNA extracted from the leaf samples of homozygous plants from 9 lines, probing for the presence of the PFA1 transgene, the pat transgene (at each end of the T-DNA), and the SpecR gene from the plasmid backbone. The Southern banding patterns of $T_1$ plants from 6580[1]-035.Sx001 and 6580[1]-035.Sx002 were similar, indicating that the events were likely of clonal origin, as were 6580[1]-052.Sx001 and 6580[1]-057.Sx001. The results of the Southern analyses are shown in Table 9.

TABLE 9

Summary of Southern analyses from twelve $T_1$ canola DHA-producing lines transformed with pDAB101496.

| $T_1$ Seed ID | DHA content of bulk seed | % null by single seed analysis | No. bands with PAT probe | No. bands with PFA1 probe | SpecR present |
|---|---|---|---|---|---|
| 6580[1]-035.Sx001 | 1.81 | 27% | 2 | 2 | No |
| 6580[1]-035.Sx002 | 2.12 | 28% | 2 | 2 | No |
| 6580[1]-052.Sx001 | 1.35 | 15% | 2 | 1 | No |
| 6580[1]-057.Sx001 | 1.41 | 20% | 2 | 1 | No |
| 6580[1]-071.Sx001 | 1.72 | 13% | n.d. | n.d. | No |
| 6580[2]-086.Sx001 | 1.59 | 15% | n.d. | n.d. | No |
| 101496[26]-293.Sx001 | 1.23 | 31% | 3 | 1 | No |
| 101496[26]-333.Sx001 | 1.68 | 30% | 2 | 2 | No |
| 101496[7]-357.Sx001 | 1.70 | 22% | 1 | 1 | No |
| 101496[8]-311.Sx001 | 1.28 | 16% | n.d. | n.d. | No |
| 6580[2]-093-Sx001 | 1.68 | 31% | 1 | 2 | Yes |
| 101496[6]-274.Sx001 | 2.39 | 25% | 2 | 1 | No |

Canola plants that were homozygous for the pDAB101496 transgenes (and including some heterozygous and null plants) were grown to maturity, and the $T_2$ seed was harvested and bulk seed samples analyzed for LC-PUFA content. Table 10. All ten selected pDAB101496 canola lines produced DHA and EPA in the $T_2$ seed. The maximum LC-PUFA contents were 3.26% DHA (line 6580[1]-035.Sx002) and 1.42% EPA (line 6580[1]-035.Sx001). The amount of ω-3 LC-PUFAs (DHA and EPA) in the lines was 80-88% (average 85%) of the total LC-PUFAs, the residual 12-20% being ω-6 DPA. Hemizygous $T_1$ plants produced less LC-PUFA due to the expected segregation of the PUFA synthase trait in $T_2$ seed. FIG. 5. The complete FAME profiles of homozygous and null seed from line canola line 6580[1]-035.Sx002 are shown in Table 10. This line produced 3.3% DHA and 1.3% EPA. There was a slight increase in alpha-linolenic (C18:3) and linoleic (C18:2) acids, and a decrease in oleic acid (C18:1) content. In addition to the expected LC-PUFAs, DHA, EPA, and DPA, low levels of new ω-6 fatty acids, such as gamma-linolenic and arachidonic acid were also detectable (0.4 and 0.7%, respectively).

TABLE 10

FAME profile of bulk $T_2$ canola seed from null and homozygous plants from canola event 6580[1]-035.Sx002. The lipid content for each fatty acid is shown as % of total FAMEs.

| Genotype | n | C14:0 | C16:0 | C16:1 | C18:0 | C18:1 | Vac C18:1 | C18:2 | GLA C18:3 | ALA C18:3 | C20:0 | C20:1 |
|---|---|---|---|---|---|---|---|---|---|---|---|---|
| Null | 3 | 0.1 | 3.9 | 0.3 | 2.3 | 67.2 | 2.2 | 12.4 | 0 | 8.2 | 1.1 | 1.3 |
| Homo | 10 | 0.1 | 4.0 | 0.2 | 2.5 | 57.8 | 2.1 | 14.9 | 0.4 | 9.8 | 0.7 | 0.9 |

| | C20:2 | ARA C20:4 | C22:0 | C22:1 | EPA C20:5 | C24:0 | DPA n6 C22:5 | DHA C22:6 | Total LC-PUFAs | EPA + DHA |
|---|---|---|---|---|---|---|---|---|---|---|
| Null | 0.1 | 0.0 | 0.5 | 0 | 0.0 | 0.3 | 0 | 0 | 0 | 0 |
| Homo | 0.1 | 0.7 | 0.3 | 0 | 1.3 | 0.1 | 0.7 | 3.3 | 5.3 | 4.6 |

| | EPA:DHA | DPA(n-6):DHA |
|---|---|---|
| Null | | |
| Homo | 1:2.54 | 1:4.71 |

Single seed LC-PUFA analysis was performed on $T_2$ seed batches from sibling homozygous and hemizygous plants from canola line 6580[1]-035.Sx002 that exhibited higher levels of DHA and EPA production in bulk seed analysis. FIG. 5. The seeds from the homozygous plants were quite uniform in DHA content with coefficients of variation (CVs) below 14%. The four samples of 48 individual seeds analyzed from plants that were homozygous for the transgenes had mean DHA contents of 3.70% (SD=0.44, CV=14%), 3.67% (SD=0.31, CV=8%), 3.11% (SD=0.36, CV=12%), and 3.11% (SD=0.35, CV=11%). The seed from the hemizygous plants contained an average of 15 null seeds per 48-seed sample, close to the value of 12 seeds predicted by Mendelian segregation of a single locus. The DHA content of individual seeds from these hemizygous plants varied up to a maximum value of 5.81%. FIG. 5.

$T_2$ seeds from homozygous lines derived from four canola events transformed with pDAB101496 were planted and grown in the greenhouse to produce $T_3$ seed. All the lines continued to produce DHA and EPA in the harvested $T_3$ seeds. Lines derived from events [6]-274.Sx001 and 6580 [1]-035.Sx002 were particularly stable for LC-PUFA production, producing in $T_3$ bulk seed measurements from individual plants an average of 3.16% DHA (range 2.73-3.61%, across 13 plants from three $T_2$ lines) and 0.78% EPA (range 0.48-1.13%) and 3.34% DHA (range 2.85-3.89% across 53 plants from 8 $T_2$ lines) and 1.12% EPA (range 0.75-1.71%), respectively.

Example 5: LC-PUFA Production in Soybean Seeds Transformed with PUFA Synthase

Transgenic $T_0$ soybean events which were produced via plant transformation using the binary constructs pDAB101454 (101454[16]-341.001 and 101454[267] 26702.001), pDAB101496 (101454[330]33007.001, 101454[333]33308.001, and 101454[334]33402.001), and pDAB10796 (107960[12]-626.001, 107960[12]-641.001, 107960[12]-644.001, 107960[26]-655.001, and 107960 [26]-733.001) were grown to maturity in the greenhouse. Soybean events were selected that contained copies of pat transgene and the accompanying PUFA synthase and HetI transgenes. The selected transgenic plants were self-fertilized, and the resulting $T_1$ seed was harvested at maturity. Single seeds were obtained and analyzed via FAMEs GC-FID to determine the LC-PUFA and DHA content. Twelve whole mature seeds per plant were individually analyzed by crushing the seed with a press and homogenization using a steel ball and ball mill. The tissue was defatted three times with hexane, the pooled hexane fractions were evaporated to dryness and the residue weighed and reconstituted in heptane for FAME analysis performed as described in the previous example. The oil content (sum of the masses of the individual FAMEs divided by seed mass) of the transgenic seeds and the number of seeds produced by the transgenic $T_1$ lines was not significantly different from that of the non-transgenic Maverick control cultivar grown in the greenhouse at the same time under the same conditions. The average and maximum level (%) of single $T_1$ seed LC-PUFAs content for selected events is summarized in Table 11. The DHA content is up to 2.0% and total PUFAs to 5.1%. Furthermore, 3 novel, non-endogenous LC-PUFAs; DHA, EPA, and DPA (n-6), were detected in the $T_1$ soybean seeds. Table 11.

TABLE 11

$T_1$ seed FAMEs analysis from 10 events expressing 3 constructs harboring the PFA1, PFA2, PFA3 and NoHetI genes. The individual seed analysis result is expressed as a maximum content for LC-PUFA, EPA, DHA and DPA and an average of all $T_1$ seeds for each event is also added. The ratio of n3 LC-PUFA (EPA and DHA)/Total LC-PUFAs was calculated.

| Event | n | LC-PUFAs | | EPA (C20:5) | |
|---|---|---|---|---|---|
| | | Mean | Max | Mean | Max |
| 101454[16]-341.Sx001 | 12 | 3.0 | 4.1 | 1.4 | 2.2 |
| pDAB101454{267}26702.001 | 12 | 0.5 | 1.0 | 0.0 | 0.1 |
| pDAB101496{330}33007.001 | 12 | 0.1 | 0.6 | 0.1 | 0.4 |
| pDAB101496{333}33308.001 | 12 | 0.5 | 1.4 | 0.4 | 1.2 |
| pDAB101496{334}33402.001 | 12 | 0.6 | 1.1 | 0.5 | 0.9 |
| 107960[12]-626.001 | 12 | 1.1 | 5.1 | 0.4 | 1.5 |
| 107960[12]-641.001 | 12 | 3.2 | 4.5 | 1.4 | 2.1 |
| 107960[12]-644.001 | 12 | 0.6 | 2.2 | 0.4 | 1.1 |
| 107960[26]-655.001 | 12 | 0.1 | 0.9 | 0.1 | 0.7 |
| 107960[26]-733.001 | 12 | 0.5 | 2.4 | 0.2 | 0.9 |

| Event | DHA (C22:6) | | DPA (C22:5) | | Ratio (n3/n3 + n6) | |
|---|---|---|---|---|---|---|
| | Mean | Max | Mean | Max | Mean | Max |
| 101454[16]-341.Sx001 | 1.3 | 1.9 | 0.3 | 0.5 | 0.8 | 0.9 |
| pDAB101454{267}26702.001 | 0.3 | 0.7 | 0.1 | 0.2 | 0.4 | 0.8 |
| pDAB101496{330}33007.001 | 0.1 | 0.2 | 0.0 | 0.0 | 0.3 | 1.0 |
| pDAB101496{333}33308.001 | 0.1 | 0.2 | 0.0 | 0.0 | 0.5 | 1.0 |
| pDAB101496{334}33402.001 | 0.1 | 0.3 | 0.0 | 0.0 | 0.9 | 1.0 |
| 107960[12]-626.001 | 0.4 | 2.0 | 0.1 | 0.5 | 0.4 | 0.9 |
| 107960[12]-641.001 | 0.9 | 1.4 | 0.2 | 0.4 | 0.7 | 0.9 |
| 107960[12]-644.001 | 0.1 | 0.5 | 0.0 | 0.2 | 0.6 | 1.0 |
| 107960[26]-655.001 | 0.0 | 0.2 | 0.0 | 0.0 | 0.1 | 0.9 |
| 107960[26]-733.001 | 0.1 | 0.9 | 0.0 | 0.3 | 0.3 | 1.0 |

DHA and EPA comprised 90% to 99% of the total LC-PUFA content in those $T_1$ seeds that contained LC-PUFA. The highest LCPUFAs content (5.1%) was achieved with construct 107960 in event 107960[12]-626.001.

The complete lipid profiles of individual $T_1$ seeds from soybean events 101454[16]-341.Sx001, pDAB101496{330}33007.001, 107960[12]-626.001, and 107960[12]-641.001 are shown in Table 12. Two individual seeds from Maverick control were added for comparison. All detected FAMES were listed.

TABLE 12

Individual seed $T_1$ Fatty Acids Methyl Ester analysis from 3 constructs and control WT Maverick. All compositions are given in weight % of detected fatty acids. Not all fatty acids were quantified at the time were the analysis was conducted (NA). A value of 0 correspond to a level below the limit of quantitation.

| Construct | Event (individual seed) | C14:0 | C16:0 | C16:1 | C18:0 | C18:1 | C18:1 Vacc. |
|---|---|---|---|---|---|---|---|
| pDAB101454 | 101454[16]-341.Sx001 | 0.1 | 10.52 | 0.07 | 3.89 | 31.69 | 1.27 |
| pDAB101496 | pDAB101496{330}33007.001 | 0.08 | 10.46 | 0.12 | 4.08 | 31.05 | 1.25 |
| pDAB101496 | pDAB101496{330}33007.001 | 0.1 | 10.91 | 0.15 | 4.28 | 30.57 | 1.35 |

TABLE 12-continued

Individual seed T₁ Fatty Acids Methyl Ester analysis from 3 constructs and control WT Maverick. All compositions are given in weight % of detected fatty acids. Not all fatty acids were quantified at the time were the analysis was conducted (NA). A value of 0 correspond to a level below the limit of quantitation.

| | | | | | | | |
|---|---|---|---|---|---|---|---|
| pDAB107960 | 107960[12]-626.001 | 0.09 | 10.09 | 0* | 3.49 | 33.25 | 1.88 |
| pDAB107960 | 107960[12]-641.001 | 0.14 | 11.97 | 0 | 4.83 | 23.4 | 2.27 |
| Maverick | 1660[467]-2871.Sx001 | 0.11 | 11.2 | 0.1 | 4.26 | 20 | 2.93 |
| Maverick | 1660[467]-2871.Sx001 | 0.11 | 11.56 | 0.11 | 4.59 | 18.84 | 2.86 |

| | C18:2 | \C18:3 | C18:3 | C20:0 | C20:1 | C20:4 | C22:0 |
|---|---|---|---|---|---|---|---|
| 101454[16]-341.Sx001 | 42.76 | NA | 6.12 | 0.33 | 0.22 | NA | 0.23 |
| pDAB101496{330}33007.001 | 45.94 | NA | 5.49 | 0.33 | 0.23 | NA | 0.35 |
| pDAB101496{330}33007.001 | 45.89 | NA | 5.94 | 0.29 | 0.23 | NA | 0.3 |
| 107960[12]-626.001 | 39.92 | 0.24 | 5.08 | 0.4 | 0.21 | 0.84 | 0.33 |
| 107960[12]-641.001 | 47.09 | 0.23 | 5.58 | 0.5 | 0.23 | 0.65 | 0.28 |
| 1660[467]-2871.Sx001 | 54.32 | 0 | 6.71 | 0.19 | 0.18 | 0 | 0 |
| 1660[467]-2871.Sx001 | 55.13 | 0 | 6.1 | 0.2 | 0.16 | 0 | 0.33 |

| | C20:5 | C24:0 | C22:5 | C22:6 |
|---|---|---|---|---|
| 101454[16]-341.Sx001 | 1.41 | 0.14 | 0.21 | 0.98 |
| pDAB101496{330}33007.001 | 0.41 | 0 | 0 | 0.19 |
| pDAB101496{330}33007.001 | 0 | 0 | 0 | 0 |
| 107960[12]-626.001 | 1.46 | 0.17 | 0.52 | 2.03 |
| 107960[12]-641.001 | 1.66 | 0 | 0.28 | 0.9 |
| 1660[467]-2871.Sx001 | 0 | 0 | 0 | 0 |
| 1660[467]-2871.Sx001 | 0 | 0 | 0 | 0 |

Example 6: Lipid Analysis of Mature T₂ Seed from Transgenic Soybean Events

To assess the inheritance of the LC-PUFA trait and its stability across generations, several representative events from the three constructs tested, 101454[16]-341.Sx001, 107960[12]-641.001, 107960[12]-644.001 and pDAB101496{334}33402.001 were selected based on their LCPUFAs content for growout in the green house. T₁ seeds were germinated in the greenhouse and T₁ plantlets were assayed for the presence of the PAT, PFA1 and NoHetI transgenes. T₁ plants with the transgenes were grown to maturity and T₂ seeds resulting from selfing were harvested for further oil analysis. From each T₂ plant, 5 to 11 T₂ seeds were analyzed individually for FAME by the method described in Example 1. The T₁ seed result was added in bold as a reference to Table 13. The T₁ lines for events 107960[12]-644.001 and pDAB101496{334}33402.001 were not homozygous, therefore, some T₂ segregating seeds did not contain LC-PUFAs (the minimum LC-PUFAs is 0). The T₂ seeds from event 101454[16]-341.Sx001 show a stable LC-PUFA content (2.2 to 5.6%) comparable to the T₁ (3%). The slight increase in mean PUFAs observed is due to the selection of homozygous plants for the transgene locus, thereby eliminating sib null seeds in the T₂ progeny. A majority of LC-PUFAs are n3 (ratio=0.9) and split between EPA (0.6 to 2.4%) and DHA (1.3 to 2.7%). The T₂ seeds from event, 107960[12]-641.001, show a similar trend compared to the parent seeds. The LC-PUFA content (1.5 to 2.1%) is comparable to the T₁ seed (3.2%). All lines selected from event pDAB101496{334}33402.001 have T₂ seeds with no LC-PUFA indicating that the T₁ plants were not fixed for the transgene locus. The average LC-PUFA content of T₂ seeds (0.1 to 1.1%) is comparable to the T₁ (0.6%). For all those constructs the LC-PUFAs trait is inherited in the next generation without a significant difference in the amount of LC-PUFAs accumulated.

TABLE 13

T₂ seed oil analysis from three events selected from three constructs. The individual seed analysis results is shown as a minimum and maximum content for total LC-PUFA, EPA, DHA, and DPA, and averaged across all seeds analyzed. A ratio of n3 LC-PUFA (EPA and DHA)/total LC-PUFA was calculated.

| | | | LC-PUFAs | | | EPA (C20:5) | | |
|---|---|---|---|---|---|---|---|---|
| Event and Line | Gen. | N | Mean | Min | Max | Mean | Min | Max |
| 101454[16]-341.Sx001 | T1 | 12 | 3.0 | | 4.1 | 1.4 | | 2.2 |
| 101454[16]-341.Sx001.Sx005 | T2 | 5 | 3.4 | 2.6 | 5.2 | 1.1 | 0.7 | 1.7 |
| 101454[16]-341.Sx001.Sx011 | T2 | 5 | 5.0 | 3.1 | 6.9 | 1.5 | 0.8 | 2.2 |
| 101454[16]-341.Sx001.Sx014 | T2 | 5 | 5.6 | 4.0 | 7.2 | 2.4 | 1.6 | 3.9 |
| 101454[16]-341.Sx001.Sx019 | T2 | 5 | 4.9 | 2.2 | 7.1 | 1.9 | 0.8 | 3.4 |
| 101454[16]-341.Sx001.Sx024 | T2 | 5 | 4.0 | 0.5 | 5.8 | 1.7 | 0.2 | 2.5 |
| 101454[16]-341.Sx001.Sx036 | T2 | 5 | 3.5 | 2.9 | 4.3 | 1.3 | 0.7 | 2.0 |
| 101454[16]-341.Sx001.Sx037 | T2 | 5 | 2.2 | 0.8 | 3.9 | 0.6 | 0.2 | 1.4 |
| 107960[12]-641.001 | T1 | 12 | 3.2 | | 4.5 | 1.4 | | 2.1 |
| 107960[12]-641.Sx001.Sx004 | T2 | 10 | 1.8 | 0.6 | 2.7 | 0.8 | 0.5 | 1.2 |
| 107960[12]-641.Sx001.Sx006 | T2 | 10 | 2.1 | 1.3 | 2.7 | 0.9 | 0.6 | 1.4 |

TABLE 13-continued

T₂ seed oil analysis from three events selected from three constructs.
The individual seed analysis results is shown as a minimum and maximum
content for total LC-PUFA, EPA, DHA, and DPA, and averaged across all seeds
analyzed. A ratio of n3 LC-PUFA (EPA and DHA)/total LC-PUFA was calculated.

| | | | | | | | | |
|---|---|---|---|---|---|---|---|---|
| 107960[12]-641.Sx001.Sx008 | T2 | 10 | 1.7 | 1.1 | 2.5 | 0.8 | 0.6 | 1.2 |
| 107960[12]-641.Sx001.Sx011 | T2 | 10 | 1.7 | 0.6 | 2.7 | 1.0 | 0.5 | 1.5 |
| 107960[12]-641.Sx001.Sx012 | T2 | 11 | 1.5 | 0.4 | 2.6 | 0.6 | 0.3 | 1.3 |
| 107960[12]-641.Sx001.Sx014 | T2 | 9 | 1.6 | 1.5 | 1.9 | 0.6 | 0.3 | 0.9 |
| 107960[12]-641.Sx001.Sx017 | T2 | 10 | 1.9 | 1.5 | 2.7 | 0.8 | 0.5 | 1.2 |
| 107960[12]-641.Sx001.Sx024 | T2 | 10 | 1.8 | 0.2 | 2.9 | 0.8 | 0.2 | 1.3 |
| pDAB101496{334}33402.001 | T1 | 12 | 0.6 | | 1.1 | 0.5 | | 0.9 |
| pDAB101496{334}33402.001-1-67 | T2 | 5 | 0.7 | 0.0 | 1.4 | 0.5 | 0.0 | 1.2 |
| pDAB101496{334}33402.001-1-68 | T2 | 5 | 1.1 | 0.0 | 2.2 | 0.9 | 0.0 | 1.8 |
| pDAB101496{334}33402.001-1-69 | T2 | 5 | 0.8 | 0.0 | 2.7 | 0.7 | 0.0 | 2.4 |
| pDAB101496{334}33402.001-1-70 | T2 | 5 | 0.1 | 0.0 | 0.7 | 0.1 | 0.0 | 0.5 |

| | DHA (C22:6) | | | DPA (C22:5) | | | Ratio (n3/n3 + n6) | | |
|---|---|---|---|---|---|---|---|---|---|
| Event and Line | Mean | Min | Max | Mean | Min | Max | Mean | Min | Max |
| 101454[16]-341.Sx001 | 1.3 | | 1.9 | 0.3 | | 0.5 | 0.8 | | 0.9 |
| 101454[16]-341.Sx001.Sx005 | 1.8 | 1.4 | 2.7 | 0.5 | 0.3 | 0.9 | 0.9 | 0.8 | 0.9 |
| 101454[16]-341.Sx001.Sx011 | 2.7 | 1.8 | 4.2 | 0.7 | 0.4 | 1.3 | 0.9 | 0.8 | 0.9 |
| 101454[16]-341.Sx001.Sx014 | 2.6 | 1.9 | 3.1 | 0.6 | 0.3 | 0.8 | 0.9 | 0.8 | 0.9 |
| 101454[16]-341.Sx001.Sx019 | 2.5 | 1.3 | 3.4 | 0.6 | 0.2 | 0.9 | 0.9 | 0.8 | 0.9 |
| 101454[16]-341.Sx001.Sx024 | 2.0 | 0.4 | 2.7 | 0.4 | 0.0 | 0.6 | 0.9 | 0.9 | 1.0 |
| 101454[16]-341.Sx001.Sx036 | 1.8 | 1.6 | 1.9 | 0.4 | 0.3 | 0.5 | 0.9 | 0.8 | 0.9 |
| 101454[16]-341.Sx001.Sx037 | 1.3 | 0.6 | 2.0 | 0.3 | 0.0 | 0.5 | 0.9 | 0.8 | 1.0 |
| 107960[12]-641.001 | 0.9 | | 1.4 | 0.2 | | 0.4 | 0.7 | | 0.9 |
| 107960[12]-641.Sx001.Sx004 | 0.5 | 0.0 | 0.8 | 0.1 | 0.0 | 0.2 | 0.8 | 0.7 | 0.9 |
| 107960[12]-641.Sx001.Sx006 | 0.6 | 0.3 | 0.9 | 0.1 | 0.0 | 0.2 | 0.7 | 0.6 | 0.9 |
| 107960[12]-641.Sx001.Sx008 | 0.5 | 0.1 | 0.8 | 0.1 | 0.0 | 0.1 | 0.8 | 0.7 | 0.9 |
| 107960[12]-641.Sx001.Sx011 | 0.4 | 0.0 | 0.6 | 0.0 | 0.0 | 0.1 | 0.8 | 0.7 | 0.9 |
| 107960[12]-641.Sx001.Sx012 | 0.4 | 0.0 | 0.6 | 0.1 | 0.0 | 0.1 | 0.7 | 0.6 | 0.8 |
| 107960[12]-641.Sx001.Sx014 | 0.6 | 0.3 | 0.7 | 0.1 | 0.0 | 0.1 | 0.7 | 0.6 | 0.8 |
| 107960[12]-641.Sx001.Sx017 | 0.6 | 0.3 | 0.9 | 0.1 | 0.0 | 0.2 | 0.7 | 0.6 | 0.8 |
| 107960[12]-641.Sx001.Sx024 | 0.5 | 0.0 | 0.9 | 0.1 | 0.0 | 0.2 | 0.8 | 0.6 | 1.0 |
| pDAB101496{334}33402.001 | 0.1 | | 0.3 | 0.0 | | 0.0 | 0.9 | | 1.0 |
| pDAB101496{334}33402.001-1-67 | 0.1 | 0.0 | 0.4 | 0.0 | 0.0 | 0.1 | 0.6 | 0.0 | 1.0 |
| pDAB101496{334}33402.001-1-68 | 0.2 | 0.0 | 0.4 | 0.1 | 0.0 | 0.1 | 0.8 | 0.0 | 1.0 |
| pDAB101496{334}33402.001-1-69 | 0.1 | 0.0 | 0.3 | 0.0 | 0.0 | 0.0 | 0.4 | 0.0 | 1.0 |
| pDAB101496{334}33402.001-1-70 | 0.0 | 0.0 | 0.2 | 0.0 | 0.0 | 0.0 | 0.2 | 0.0 | 1.0 |

Example 7: LC-PUFA Production in Canola Seeds from pDAB101496 Grown in the Field $T_2$ canola seed batches from several homozygous $T_1$ plants derived from six pDAB101496 (SEQ ID NO:17) canola events producing moderate to high levels of DHA (described above) were independently pooled. This seed was planted in the field in Minnesota and North Dakota in 2013. Canola seed entries from untransformed plants were used as controls and commercially available canola lines were used as checks. Four replicate plots (1.2×6 m) were planted for each seed entry and at maturity the resulting seed ($T_3$ seed in the case of the transgenic samples) was harvested from each plot and analyzed for LC-PUFA content. The LC-PUFA content of the harvested canola grain from each experimental plot was determined from FAME extractions of three 10-seed aliquots sampled from bulk grain from each of the four replicate field plots. Table 14.

Across the four field plots per entry, the maximum DHA and EPA contents were 4.27% and 0.65%, respectively, for Event 6580[1]-035.Sx002. The maximum DHA content from an individual plot was 4.54%. The same $T_2$ seed lines that were bulked for each event for planting in the field were also grown in the greenhouse to compare the LC-PUFA contents of the resulting $T_3$ seed. The DHA contents of the top four field grown pDAB101496 lines were on average 22% higher than the equivalent lines grown in the greenhouse. Table 14.

TABLE 14

LC-PUFA content (% Total FAMEs) of $T_3$ canola seed from transgenic events transformed with pDAB101496 grown in the field and greenhouse.

| Event ID | Location | # of samples* | Average DHA | Average EPA | Average DPAn6 | Average Total LC-PUFAs | Average DHA + EPA |
|---|---|---|---|---|---|---|---|
| 101496[26]-293.Sx001 | Field MN | 4 | 2.50 | 0.37 | 0.62 | 4.02 | 2.86 |
| | Field ND | 4 | 2.23 | 0.70 | 0.46 | 4.08 | 2.93 |
| | Greenhouse | 29 | 2.00 | 0.25 | 0.52 | 3.17 | 2.25 |
| 101496[26]-333.Sx001 | Field MN | 4 | 1.42 | 0.12 | 0.40 | 2.24 | 1.55 |
| | Field ND | 4 | 1.77 | 0.52 | 0.24 | 2.94 | 2.29 |
| | Greenhouse | 29 | 0.78 | 0.08 | 0.20 | 1.23 | 0.86 |

TABLE 14-continued

LC-PUFA content (% Total FAMEs) of $T_3$ canola seed from transgenic events transformed with pDAB101496 grown in the field and greenhouse.

| Event ID | Location | # of samples* | Average DHA | Average EPA | Average DPAn6 | Average Total LC-PUFAs | Average DHA + EPA |
|---|---|---|---|---|---|---|---|
| 101496[6]-274.Sx001 | Field MN | 4 | 3.77 | 0.60 | 1.02 | 6.26 | 4.37 |
| | Field ND | 4 | 3.06 | 0.81 | 1.01 | 5.93 | 3.88 |
| | Greenhouse | 29 | 2.91 | 0.66 | 0.73 | 5.05 | 3.57 |
| 101496[7]-357.Sx001 | Field MN | 4 | 2.71 | 0.33 | 0.75 | 4.40 | 3.04 |
| | Field ND | 4 | 2.75 | 0.78 | 0.59 | 4.92 | 3.53 |
| | Greenhouse | 30 | 2.06 | 0.40 | 0.53 | 3.52 | 2.46 |
| 6580[1]-035.Sx002 | Field MN | 4 | 4.27 | 0.65 | 1.04 | 6.93 | 4.92 |
| | Field ND | 4 | 3.86 | 0.95 | 0.98 | 6.90 | 4.81 |
| | Greenhouse | 53 | 3.36 | 1.18 | 0.78 | 6.37 | 4.54 |
| 6580[1]-057.Sx002 | Field MN | 4 | 2.33 | 0.27 | 0.63 | 3.65 | 2.60 |
| | Field ND | 4 | 2.50 | 0.70 | 0.56 | 4.45 | 3.20 |
| | Greenhouse | 29 | 1.57 | 0.29 | 0.42 | 2.65 | 1.86 |

*Numbers are bulk seed from field plots for field samples or bulk seed from individual plants for greenhouse samples There were no significant differences in grain yield for the transgenic canola lines producing DHA relative to the non-transgenic DH12075 plants. Table 15. All lines grown in the field produced seed with average oil contents of >40% g oil/g seed. There were no significant differences between transgenic and non-transgenic controls in chlorophyll content of the seed, or in % seed protein per gram of meal after oil extraction. Flowering time and time to maturity was unchanged between the transgenic lines and the control plants.

TABLE 15

$T_3$ seed yield of from homozygous T2 transgenic DHA-producing canola plants transformed with pDAB101496 grown in the field, compared with non-transgenic DH12075 canola. Yields are the average of four plots per location (SD = standard deviation of the mean).

| Event ID | Location | Average Seed Yield, llbs per plot (SD) |
|---|---|---|
| 101496[26]-293.Sx001 | Field MN | 3.55 (0.88) |
| | Field ND | 2.53 (0.39) |
| 101496[26]-333.Sx001 | Field MN | 3.10 (0.25) |
| | Field ND | 2.72 (0.38) |
| 101496[6]-274.Sx001 | Field MN | 3.25 (0.44) |
| | Field ND | 2.65 (0.20) |
| 101496[7]-357.Sx001 | Field MN | 3.95 (0.25) |
| | Field ND | 2.56 (0.09) |
| 6580[1]-035.Sx002 | Field MN | 3.55 (0.57) |
| | Field ND | 3.00 (0.40) |
| 6580[1]-057.Sx002 | Field MN | 3.60 (0.23) |
| | Field ND | 2.67 (0.17) |
| DH12075 1 | Field MN | 3.70 (0.11) |
| | Field ND | 2.59 (0.56) |
| DH12075 2 | Field MN | 2.95 (0.25) |
| | Field ND | 2.57 (0.22) |

Batches of grain from the field trial were pooled and crushed to extract LC-PUFA-containing oil, and the oil processed through refining, bleaching and deodorizing using standard methods. Two batches of seed were processed to yield 1.2 kg RBD oil containing 3.02% DHA and 1.0% EPA and 1.0 kg RBD oil containing 4.1% DHA and 0.7% EPA. This demonstrates that the grain from the transgenic canola plants expressing PUFA synthase and HetI can be processed to produce canola oil highly enriched in DHA and EPA.

Example 8: LC-PUFA Trait Stability Across Multiple Seed Generations for pDAB107960 Canola Events For plasmid pDAB107960, when tested in *Arabidopsis*, combining the use of diversified promoter/terminator combinations and use of three native PUFA synthase sequences in the second orientation PTU format led to consistent LC-PUFA trait stability into the $T_3$ seed generation. Table 5. Canola events generated with pDAB107960 were similarly tested for LC-PUFA trait stability over three selfed crop seed generations.

$T_1$ seeds from nine pDAB107960 canola events selected by single seed analysis of $T_1$ seed as previously described were planted in the greenhouse. Plants homozygous for the pDAB107960 transgenes and segregating as a single Mendelian locus were grown to maturity, and the $T_2$ seed was harvested from plants and the seed samples analyzed for LC-PUFA content. All plants from the nine selected pDAB107960 canola events produced DHA and EPA in the $T_2$ seed. Table 16. $T_2$ seeds from seven events (113 plants) were planted in the greenhouse, grown to maturity and $T_3$ seed was harvested from these plants. Seed samples were again analyzed from each progeny plant for LC-PUFA content. All 113 $T_2$ canola plants from the seven selected pDAB107960 events produced DHA and EPA in the $T_3$ seed. Table 16. $T_3$ seeds derived from six events (137 plants) were planted in the greenhouse, grown to maturity and $T_4$ seed harvested from these plants. All 137 canola $T_3$ plants from the six selected pDAB107960 events produced DHA and EPA in the $T_4$ seed. Table 16. Five of the six events tested maintained similar high levels of DHA in each seed generation, demonstrating DHA trait stability across multiple events.

TABLE 16

LC-PUFA content of $T_2$, $T_3$, and $T_4$ canola seed from homozygous lines from pDAB107960 canola events. The LC-PUFA contents are shown as % of total FAMEs.

| Event ID | Seed Generation | Number of plants | Average DHA content | Average EPA content | Average EPA + DHA content | Average Total LC-PUFA content |
|---|---|---|---|---|---|---|
| 107960[6]-646 | $T_2$ | 4 | 2.59 | 0.75 | 3.34 | 4.77 |
| 107960[27]-702 | $T_2$ | 10 | 2.83 | 0.34 | 3.17 | 4.66 |
| 107960[4]-100 | $T_2$ | 21 | 2.42 | 0.29 | 2.72 | 3.90 |
|  | $T_3$ | 6 | 2.33 | 0.48 | 2.81 | 4.10 |
| 107960[7]-085 | $T_2$ | 22 | 2.32 | 0.32 | 2.64 | 3.75 |
|  | $T_3$ | 24 | 2.45 | 0.63 | 3.08 | 4.43 |
|  | $T_4$ | 30 | 3.65 | 0.62 | 4.26 | 6.06 |
| 107960[6]-106 | $T_2$ | 8 | 3.25 | 0.79 | 4.04 | 5.41 |
|  | $T_3$ | 25 | 2.59 | 1.04 | 3.63 | 4.84 |
|  | $T_4$ | 30 | 3.26 | 1.05 | 4.31 | 5.78 |
| 107960[6]-107 | $T_2$ | 22 | 2.98 | 0.42 | 3.39 | 4.77 |
|  | $T_3$ | 18 | 2.57 | 0.54 | 3.11 | 4.32 |
|  | $T_4$ | 27 | 2.64 | 0.43 | 3.07 | 4.23 |
| 107960[7]-111 | $T_2$ | 22 | 3.03 | 0.32 | 3.35 | 4.87 |
|  | $T_3$ | 23 | 2.78 | 0.54 | 3.31 | 4.88 |
|  | $T_4$ | 30 | 2.02 | 0.24 | 2.26 | 3.39 |
| 107960[6]-352 | $T_2$ | 8 | 2.81 | 0.31 | 3.12 | 4.36 |
|  | $T_3$ | 24 | 2.71 | 0.52 | 3.23 | 4.67 |
|  | $T_4$ | 27 | 3.08 | 0.47 | 3.55 | 5.15 |
| 107960[6]-353 | $T_2$ | 10 | 2.90 | 0.40 | 3.30 | 4.38 |
|  | $T_3$ | 23 | 3.07 | 0.66 | 3.73 | 5.19 |
|  | $T_4$ | 22 | 3.73 | 0.67 | 4.40 | 6.22 |

The transgene copy numbers in the six single locus pDAB107960 canola events taken to the $T_4$ seed generation were determined as described previously. Events 107960[6]-106, 107960[6]-107, 107960[7]-111, and 107960[6]-353 contained two copies of all the transgenes, whereas events 107960[7]-085 and 107960[6]-352 contained one copy of all the transgenes (PFA1, PFA2, PFA3, NoHetI). Thus, the LC-PUFA trait was delivered with either one or two copies of the transgene set and remained stable across three seed generations.

The complete FAME profiles of bulk $T_4$ seed samples from two $T_3$ plants derived from two different events (107960[7]-085 and 107960[6]-353) are shown in Table 17. These seeds contained 4.4% and 4.6% DHA, and 0.6% and 0.7% EPA, respectively. There was a concomitant decrease (−8%) in oleic acid (C18:1) content, and slight increase (+2%) in linoleic acid (18:2) content, and otherwise the profile was not significantly altered by the presence of the new LC-PUFAs. In addition to the expected LC-PUFAs, DHA, EPA, and DPA(n-6), low levels of new ω-6 fatty acids, gamma-linolenic (GLA, 18:3) and arachidonic acid (ARA, 20:4), were also detectable (totaling around 1%).

TABLE 17

FAME profile of T4 canola seed derived from two pDAB107960 events compared with control seed from non-transgenic DH12075. The fatty acid content is shown as % of total FAMEs.

| Event ID | C14:0 | C16:0 | C16:1 | C18:0 | C18:1 | C18:1 Vacc. | C18:2 | GLA 18:3 | C18:3 | C20:0 |
|---|---|---|---|---|---|---|---|---|---|---|
| DH12075* | 0.07 | 4.03 | 0.15 | 3.27 | 63.39 | 2.29 | 14.17 | 0.00 | 9.42 | 0.96 |
| 107960[7]-085 | 0.07 | 3.61 | 0.24 | 2.87 | 55.35 | 2.20 | 16.35 | 0.53 | 9.06 | 0.97 |
| 107960[6]-353 | 0.06 | 3.82 | 0.21 | 2.39 | 55.69 | 2.11 | 16.53 | 0.49 | 9.32 | 0.80 |

| Event ID | C20:1 | ARA C20:4 | C22:0 | EPA C20:5 | C24:0 | DPA C22:5 | DHA C22:6 | Total LC-PUFA | EPA + DHA | Ratio (N3/PUFAs) |
|---|---|---|---|---|---|---|---|---|---|---|
| DH12075* | 1.32 | 0.00 | 0.48 | 0.00 | 0.30 | 0.00 | 0.00 | 0.00 | 0.00 | 0.00 |
| 107960[7]-085 | 1.10 | 0.45 | 0.40 | 0.59 | 0.30 | 1.25 | 4.44 | 7.26 | 5.03 | 0.69 |
| 107960[6]-353 | 1.00 | 0.48 | 0.32 | 0.69 | 0.21 | 1.15 | 4.56 | 7.37 | 5.25 | 0.71 |

*No plasmid

Example 9: LC-PUFA Production in $T_4$ Canola Seeds from pDAB107960 Grown in the Field $T_3$ canola seed batches from homozygous $T_2$ plants derived from six different pDAB107960 canola events producing around 3% DHA (described above) were independently pooled. This seed was planted in the field at two locations in North Dakota in 2014. Canola seed entries from untransformed DH12075 plants were used as controls, and commercially available canola lines were used as checks. Four replicate plots (1.2×6 m) were planted for each seed entry, and the resulting seed ($T_4$ seed for transgenic samples) was harvested from each plot and analyzed for LC-PUFA content by FAMES analysis, as described previously. FAME extractions were performed on three 10-seed technical replicates sampled from bulk grain from each of the four replicated field plots. Table 18.

TABLE 18

LC-PUFA content (as % of total FAMEs) of $T_4$ canola seed from transgenic events transformed with pDAB107960 grown in the field in North Dakota. Values are the average of four replicated plots at each site.

| Event ID | Location | Average DHA content | Average EPA content | Average EPA + DHA content | Average Total LC-PUFA content |
|---|---|---|---|---|---|
| 107960[7]-085 | Site 1 | 3.70 | 0.50 | 4.20 | 5.83 |
| | Site 2 | 3.56 | 0.45 | 4.01 | 5.58 |
| 107960[6]-106 | Site 1 | 3.42 | 0.88 | 4.30 | 5.61 |
| | Site 2 | 3.09 | 0.76 | 3.84 | 4.97 |

TABLE 18-continued

LC-PUFA content (as % of total FAMEs) of $T_4$ canola seed from transgenic events transformed with pDAB107960 grown in the field in North Dakota. Values are the average of four replicated plots at each site.

| Event ID | Location | Average DHA content | Average EPA content | Average EPA + DHA content | Average Total LC-PUFA content |
|---|---|---|---|---|---|
| 107960[6]-107 | Site 1 | 2.97 | 0.40 | 3.37 | 4.52 |
| | Site 2 | 2.47 | 0.34 | 2.81 | 3.80 |
| 107960[7]-111 | Site 1 | 3.10 | 0.29 | 3.39 | 4.83 |
| | Site 2 | 2.57 | 0.22 | 2.79 | 3.99 |
| 107960[6]-352 | Site 1 | 3.17 | 0.40 | 3.57 | 5.03 |
| | Site 2 | 3.21 | 0.34 | 3.55 | 4.92 |
| 107960[6]-353 | Site 1 | 3.98 | 0.55 | 4.53 | 6.23 |
| | Site 2 | 3.60 | 0.53 | 4.13 | 5.58 |

The maximum DHA and EPA contents (average of four plots per entry) were 3.98% and 0.88% for Event 107960[6]-353 and 107960[6]-106, respectively, at Site 1. The maximum DHA content from an individual plot was 4.69% at Site 1 for Event 107960[6]-353. The same $T_3$ seed lines that were bulked for each event for planting in the field were also grown in the greenhouse to compare the LC-PUFA contents of the resulting $T_4$ seed. Table 16. The average DHA content across all six field grown pDAB107960 events at both sites was 3.24%, whereas the average DHA content across all the equivalent events grown in the greenhouse was 3.06%. Thus, the DHA content of the field-grown canola was on average +6% higher than the equivalent greenhouse-grown material.

SEQUENCE LISTING (40 sequences)

SEQ ID NO: 1 - protein, 2607 aa, Schizochytrium sp.
MDTRIAIVGMSAILPSGENVRESWEAIRDGLDCLSDLPADRVDVTAYYNPEKTTKDKIYCKRGGFIPEYDFDAREFGLNMFQMEDSDANQTISLLKVKEALTDANIPAFSSGKKNIGCVLGIGGGQKASHEFYSRLNYVVVDKVLRKMGLPEEDVAAAVDKYKASFPEWRLDSFPGFLGNVTAGRCCNTFNMEGMNCVVDAACASSLIAVKVAIEELLYGDCDAMIAGATCTDNSIGMYMAFSKTPVFSTDPSVKAYDAATKGMLIGEGSAMLVLKRYADAVRDGDTVHAVIKGCASSSDGKAAGIYTPTISGQEEALRRAYARANVDPATVTLVEGHGTGTPVGDKIELTALSNLFSKAFSANGGGAEEAEQVAVGSIKSQIGHLKAVAGLAGLVKVVLALKHKTLPQTINVDKPPSLVDGTPIQQSPLYVNTMNRPWFTPVGVPRRAGVSSFGFGGANYHAVLEEFEPEHESAYRYNNLPQVALLHAGDVATLAATVRAKLALATAEQEEARVVKNADYIAYHRFLDECKLRGAVPQAHARVGLLVRDLSSLIAVLEAAAAKLAGEESATEWTVSVATGEAAFRVRGVATEANVAALFSGQGAQYTHMFSDVAMNWPPFRESVAAMDRAQRERFGRPAKRVSSVLYPRKPYGDEPRQDHKEISQTRYSQPATLACSVGAFDIFKAAGLAPSFAAGHSLGEFAALYAAGSLDRDAVFDLVCARAKAMSDFTAQASSSGGAMAAVIGAKADQLSLGGAPDVWLANSNSPSQTVITGTAEAVAAASDKLRCSGNFRVVPLACEAAFHSPHMRGAEQTFASALAQAPVSAPAAARFYSNVTGGAAVTSPADVKTNLGKHMTSPVQFVQQVRAMHAAGARVFVEFGPKQVLSRLVKETLGEAGDVVTVAVNPDSAKDSDTQLRQAALTLAVAGVPLKDFDRWQLPDATRLEPVKKKKTTLRLSAATYVSAKTLRQREAVLNDGYTVSGATAVVKEVDTANEERLVRQAQDLQRQLAEASTAAQAAQSKVAELERTIQDLERKVQQQQQEKGENSDSNAAAEVLRRHKELLQRMLQDCDEQAVPVATVVPTPTSSPTPTSSPVSGNSKSTRGSADLQALLAKAETVVMAVLAAKTGYEADMVEADMDLEAELGIDSIKRVEILSEVQGQLGVEAKDVDALSRTRTVGEVVDAMKAEIVAASGGSAPAVPSAPAASAAPTPAASTAPSADLQALLSKAETVVMAVLAAKTGYEADMVEADMDLEAELGIDSIKRVEILSEVQGQLGVEAKDVDALSRTRTVGEVVDAMKAEIVAASAGSAPAPAVPSAPAASAAPTPAASTAPSADLQALLSKAETVVMAVLAAKTGYEADMVEADMDLEAELGIDSIKRVEILSEVQGQLGVEAKDVDALSRTRTVGEVVDAMKAEIVAASGGSAPAPAVPSAPAASAAPTPAAATAPSADLQALLAKAETVVMAVLAAKTGYEADMVEADMDLEAELGIDSIKRVEILSEVQGQLGVEAKDVDALSRTRTVGEVVDAMKAEIVAASAGSAPAPAVPSAPAASAAPTPAASTAPSADLQALLSKAETVVMAVLAAKTGYEADMVEADMDLEAELGIDSIKRVEILSEVQGQLGVEAKDVDALSRTRTVGEVVDAMKAEIVAASGGSAPAAAVPSAPAASAAPTPATAPSADLQALLSKAETVVMAVLAAKTGYEADMVEADMDLEAELGIDSIKRVEILSEVQGQLGVEAKDVDALSRTRTVGEVVDAMKAEIVAASGGSAPAAPSAPALLPTLFGSECEDLSLTFPVITTLPLPAELVLAEGGARPVVVVDDGSALTSSLVSSLGDRAVLLQVQSSSACSPRSTTHKLVTVADRSEAALQAALTSVEAQFGKVGGFVFQFGDDDVQAQLGWALLAAKHLKTSLSEQIEGGRTFFVAVARLDGQLGLSGKSTTATVDLSRAQQGSVFGLCKTLDLEWPAVFCRGIDLAADLDAAQAARCLLGELSDPDVAVRESGYSASGQRCTTTTKSLTTGKPHQPISSSDLFLVSGGARGITPLCVRELAQRVGGGTYVLIGRSELPTTEPAWAVGVESGKPLEKAALAFLKAEFAAGRGAKPTPMLHKKLVGAVVGAREVRASLAEITAQGATAVYESCDVSSAAKVREMVERVQQQGGRRVSGVFHASGVLRDKLVENKSLADFSAVYDTKVGGLINLLACVDLAQLRHLVLFSSLAGFHGNVGQSDYAMANEALNKLAAHLSAVHPQLCARSICFGPWDGGMVTPALKANFIRMGIQIIPRQGGAQTVANMLVSSSPGQLLVGNWGVPPVVPSATEHTVLQTLRQSDNPFLDSHVIQGRRVLPMTLAVGYMAHQAQSIYAGHQLWAVEDAQLFKGIAIDNGADVPVRVELSRRKEEQEDAGKVKVKVQVLLKSQVNGKSVPAYKATVVLSPAPRPSVITRDFDLTPDPACTEHDLYDGKTLFHGKAFQGIEQVLSATPKQLTAKCRNLPLTPEQRGQFVVNLSQQDPFQADIAFQAMLVWARMLRQSAALPNNCERFDFYKPMAPGATYYTSVKLASASPLVDSVCKCTVAMHDEQGEVYFSARASVVLNKTLTY

SEQ ID NO: 2 - DNA, 7824 bp, Schizochytrium sp.
atggatactcgcatcgcgatcgtggggatgtcggcgatcctgccgagcggggagaacgtgcgcgagagctgggaggcgatccgcgatgggctggattgcctgagcgatctgccggcggaccgcgtggacgtgacggcctactacaacccggagaagacgaccaaggacaagatctactgcaagcgcggcgggttcatcccggagtacgacttcgacgcgcgtgagttcgggctcaacatgttccagatggaggactcggacgccaaccagacgatctcgctgctcaaggtgaaggaggcgctgacggacgccaacatcccggcgttctcgagcggtaagaagaacatcggctgcgtgctgggcatcggcggcggccagaaggcgagccacgagttctactcgcggctcaactacgtggtcgtggacaaggtgctgcgcaagatgggcctgccggaggaagacgtggcggcggcggtggacaagtacaaggcgagtttccccgagtggcgcctcgactctttccccgggttcctgggcaacgtcacggcggggcgctgctgcaataccttcaacatggagggcatgaactgcgtcgtggacgcggcctgcgcgtcgtcgctgatcgcggtcaaagtggcgatcgaggagctgctctacggcgactgcgatgcgatgatcgcgggtgccacctgcacggacaactcgatcgggatgtacatggccttctccaagacgcccgtgttttccacggacccgagcgtcaaggcgtacgacgccgccaccaaaggcatgctcatcggcgagggctcggcgatgctcgtgctgaagcgctacgcggacgccgtgcgcgacggcgacaccgtgcacgccgtcatcaaggggtgcgcgtcctcgagcgacggcaaggcggcgggcatctacacgccgacaatctcgggccaggaggaggccctgcgccgcgcctacgcccgcgccaatgtcgacccggccactgtgacgctggtggagggccacggcacgggtacgccggtgggcgacaagatcgagctgacggcgctgagcaacctcttctccaaggcgttttctgccaacggtggcggcgcggaggaagcagagcaggtggcggtgggcagcatcaagtcgcagatcgggcacctcaaggcggtggccgggctggccgggctggtcaaggtggtgctggcgctcaagcacaagacgctgccgcagacgatcaacgtcgacaagccgccgtcgctggtggacgggaccccgatccagcagtcgccgctgtacgtcaacacgatgaaccgcccctggttcacgcccgtaggggtgccgcgccgcgccggcgtgtcgtcgtttgggtttggcggtgccaactaccacgccgtgctggaggagtttgagcccgagcacgagagcgcgtaccggtacaacaacctgccgcaggtggcgctgctgcacgcgggggacgtcgcgaccttggcggcgacggttcgcgccaagctggcgctggccaccgccgagcaggaagaggcgcgtgtggtgaagaacgcggactacatcgcgtaccaccggttcctggacgagtgcaagttgcgcggcgctgtgccgcaggcgcacgcgcgggtgggactgctcgtacgggacctgagctcgctcatcgccgtgctcgaggccgctgccgccaagctcgcgggcgaagagagcgcgacggagtggacggtcagcgttgctacgggcgaggcggccttccgcgtgcgcggtgtggctacggaggccaacgtggcggcgctgttctcgggccagggcgcgcagtacacgcacatgttcagcgacgtggcgatgaactggcccccgttccgcgagagcgtcgccgccatggaccgcgcccagcgcgagcgcttcgggcggcctgccaagcgcgtgagcagcgtgctgtacccgcgcaagccgtacggcgacgaaccgcggcaggaccacaaggagatctcgcaaacgcgctactcgcagcccgcaacgctcgcgtgctcggtcggcgcctttgacatcttcaaagcggcgggactggcgccgagctttgcggcgggccactcgctgggcgagtttgcggcgctctacgcggccgggtcgctcgatcgcgacgccgtcttcgacctggtctgcgcgcgcgccaaggccatgagcgacttcacggcccaggccagcagcagcggtggcgccatggcggccgtgattggcgccaaggcggaccagctctcgctgggtggcgcgcccgacgtgtggctcgccaacagcaactcgccctcgcagaccgtgatcacgggaaccgccgaagcagtggctgcggcctctgacaagttgcgctgcagcggcaacttccgcgtcgtgcctctggcctgcgaggcggccttccactcgccgcacatgcgcggcgcggagcagacgtttgcgtcggcgctcgcgcaggcgcccgtgtcggcaccggcggctgctcggttctactctaacgtgacggggggcgccgcggtaacctcgcccgcggacgtcaaaacgaacctgggcaagcacatgacgagccctgtgcagttcgtgcagcaggtgcgagccatgcacgcggcgggcgcgcgtgtgtttgtggagtttgggcccaagcaggtcctgtcgcgcctcgtcaaggagacccttggcgaggccggcgacgtggtcacggtcgccgtcaacccagactcggccaaggacagcgacacgcagctgcgccaggcggcgctcacgttggcggtcgccggcgtgccgctcaaggactttgaccgctggcagctgccggatgccacgcgcctcgagcctgtcaagaagaagaagaccacgttgcggctctcggcagccacctacgtctccgccaagacgttgcgccagcgcgaggccgtgctcaacgacggctacactgtcagtggtgccacggcggtagtcaaggaagtggacacggccaacgaggagcgtctcgtccgccaagcccaggatctccagcgccagctcgcggaggcctcgacggcagcccaggcggcgcagtccaaggtcgcggagctcgagcgcacgatccaggacttggagcgcaaggtgcagcagcagcagcaagagaagggtgagaactcagacagcaacgctgccgccgaagtgctgcggcgccacaaggagctgctccagcgcatgctgcaggactgtgacgagcaggcagtgcccgtagccacggtggttccgacacctacgtcctccccgacgcctacatcctcacccgtatccggcaacagcaagagcactcgtggcagtgctgatctgcaagcgctgctggccaaggcggagactgtggtgatggctgtgctggctgccaagactggctacgaggccgacatggttgaggcggacatggacctggaggccgagctcggcatcgactcgatcaagcgcgtggagatcctttccgaggtgcagggccagctgggcgtcgaggccaaggacgtggatgcgctgagccgcacgcgcacggtcggtgaggttgtggacgccatgaaggcggagatcgtggctgcctctggtggtagtgctcctgcggttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctgctggtagtgctcctgctcctgctgttccttcggcgcccgctgcttctgcagctccgactcccgctgcttcgactgcgccttctgctgatctgcaagcgctgctgtccaaggcggagacggtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctcctgcggttccttcggcgcccgctgcttctgcagctccgactcccgcggctgcgacagcgccttctgctgatctgcaagcgctgctggccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaggttgtggatgccatgaaggcggagatcgtggctgcctctgctggtagtgctcctgctcctgctgttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctgctgctgttccttcggcgcccgctgcttctgcagctccgactcctgcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaagtggtggacgccatgaaggcggagatcgtggctgcctctggtggtagtgctcctgctgctccttcggcgcccgcgcttcttccaacgctgtttggttccgagtgcgaggacctgtctctgacctttcccgtgataacgaccctgccgcttcctgcagagcttgtgctggccgagggcggcgctcgccctgtagtcgtggtggatgatggatctgcactcacctcgtcgctggtgtcctcgctcggcgatcgtgcggtgctgctgcaggtgcagtcttcctctgcctgctcgccgcgctcgaccacgcacaagttggtgaccgtagcagaccgctctgaagcggcgctacaggcggcgctcacgtccgtcgaggcgcagttcggcaaggtgggtggctttgtgttccagttcggcgacgacgacgtgcaagcgcagctcggctgggcgctgctcgcggccaagcacctcaaaacttcgctgtcagaacagatcgagggcggtcgcacctttttcgtggccgtcgcgcggctcgacggccagctggggctctccggcaagtcgacgaccgctaccgttgatctctcccgcgcgcagcagggcagcgtgttcggcctgtgcaagacactcgacctggagtggcccgctgtcttctgccgcggaatcgacctggccgccgacctcgacgccgcacaggccgcgcggtgcctgctgggcgagctgtcagaccccgacgtggccgtgcgcgagtctggttactccgcctcgggccagcgctgcacgacaactacgaagtcgctgactacgggcaagccgcaccagccgatctcctcgtcggacctctttctggtgtcgggcggcgcgcgcggcatcaccccgctgtgcgtgcgcgagctggcgcagcgcgtgggcggcggcacgtacgtgctcatcggccgctcggagctgcccacgacggagcctgcctgggcggtcggcgtggagtctggcaagccgctggagaaggccgcgctggcgttcctgaaggcggagtttgcagcgggccgcggggccaagccgacgccgatgctgcacaagaagctcgtgggcgccgtggtcggagcgcgcgaggtgcgagcctcgctcgccgagatcactgcacagggcgccacggctgtgtacgagtcgtgcgacgtgagctctgccgccaaggtgcgtgagatggtagagcgcgtgcagcagcagggcgggcggcgcgtgtcgggcgtgttccacgcgtcgggcgtgctgcgcgacaagctcgtggagaacaagtcgctggcggacttcagcgccgtgtacgacaccaaggtgggcggcctcatcaacctgctggcctgcgtggacctggcgcagctgcgtcacctcgtgctcttcagctcgctcgcgggcttccacggcaacgtcgggcagtcggactacgcaatggccaacgaggcgctcaacaagctggcggcgcacctgtcggcggtgcacccgcagctgtgcgcgcgctcgatctgcttcggaccgtgggacggcggcatggtgacccccgcgctcaaggccaacttcatccgcatgggcatccagatcatcccgcgccaaggcggcgcgcagaccgtcgccaacatgctcgtcagtagctcccccggtcagctgctcgtgggcaactggggcgtgccacccgtcgtgccgagtgccaccgagcacaccgtgctgcagacgctccgccagagcgacaaccccttcctcgactcgcacgtgatccagggccgccgcgtgctgcccatgaccctggccgtgggctacatggcgcaccaggcgcagagcatctacgcgggccaccagctgtgggccgtcgaggacgcccagctcttcaagggcatcgccatcgacaatggcgccgacgtgcccgtgcgcgtggagctgtcgcgccgcaaggaggagcaggaggacgccggcaaggtcaaggtcaaggtgcaggtgctgctcaaatcgcaggtcaacggcaagtcggtgcccgcgtacaaggcgaccgtcgtgctgtcccctgcgccgcgccccagcgtcatcacgcgtgacttcgacctcaccccggacccggcctgcacggagcacgacctctacgacggcaagacgctcttccacggcaaggccttccagggcatcgagcaggtgctctcggcgacgcccaagcagctcaccgccaagtgccgcaatttgcccctcacgcccgagcagcgcggccagttcgtcgttaacctcagccagcaggacccgttccaggcggacattgcgttccaggcgatgctcgtctgggcgcgcatgctgcgccaatcggcggccctgcccaacaactgcgagcgcttcgacttttacaagccgatggccccgggcgccacctactacacgtcggtcaagctggcctcggcctcacccttggtggactctgtgtgcaagtgcaccgtggcgatgcacgatgagcaaggtgaggtgtacttttctgctcgtgccagcgtcgtcctcaacaagaccctcacgtactaa

SEQ ID NO: 3 - DNA, 7824 bp, Artificial Sequence
  Plant-optimized PUFA synthase PFA1
atggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactga

SEQ ID NO: 4 - protein, 1925 aa, Schizochytrium sp.
MPCDNIAVVGMAVQYAGCKNQDEFWDTLMRKEINSSPISAERLGTRYRDLHFHPQRSKYADTFCNDRYGCVDASVDNEHDLLADLARRALLDAGINLDDASTTANLRDFGIVSGCLSFPMDNLQGELLNLYQVHVENRVGAQRFRDSRPWSERPRAVSPEASDPRVYSDPASFVANQLGLGPVRYSLDAACASALYCLKLASDHLLSRSADVMLCGATCFPDPFFILSGFSTFQAMPLGGPDDNPLSVPLRQGSQGLTPGEGGAIMVLKRLEDAVRDGDRIYGTLLGTSLSNAGCGLPLSPHLPSEKSCMEDLYTSVGIDPSEVQYVECHATGTPQGDVVEVEALRHCFRGNTDHPPRMGSTKGNFGHTLVAAGFAGMAKVLLSMQHGTIPPTPGVDRSNCIDPLVVDEAIPWPYSSAQARAGKPGDELKCASLSAFGFGGTNAHCVFREHRQIAATATASPVLPEVTPGPIAIIGMDATFGTLKGLDAFEQAIYKGTDGASDLPSKRWRFLGADTDFLTAMGLDAVPRGCYVRDVDVDYKRLRSPMIPEDVLRPQQLLAVATMDRALQDAGMATGGKVAVLVGLGTDTELYRHRARVTLKERLDPAAFSPEQVQEMMDYINDCGTSTSYTSYIGNLVATRVSSQWGFTGPSFTVTEGANSVYRCLELGKFLLDTHQVDAVVVAGVDLCATAENLYLKARRSAISRQDHPRANFEASADGYFAGEGSGALVLKRQADVGSDDKVYASVAGLTCAAQPAEAVSPLLLQVHNDDNEKRVVEMVELAADSGRHAPHLANSPLSAESQLEQVSKLLAHQVPGSVAIGSVRANVGDVGYASGAASLIKTALCLHNRYLPANPQWERPVAPVSEALFTCPRSRAWLKNPGESRLAAVASASESGSCFGVLLTDEYATHESSNRLSLDDAAPKLIAIRGDTVDDIMAKVNAELALLRAHAETGSATDDDPAAAVAFTAHRLRFLRLVGETVASHGATATLCLALLTTPEKLEKELELAAKGVPRSAKAGRNWMSPSGSAFAPTPVTSDRVAFMYGEGRSPYYGVGLDLHRLWPALHERINDKTAALWENGDSWLMPRAVDADSQRAVQTAFDADQIEMFRTGIFVSICLTDYARDVLGVQPKACFGLSLGEISMLFALSRRNCGLSDQLTQRLRTSPVWSTQLAVEFQALRKLWNVPADAPVESFWQGYLVRASRAEIEKAIGPDNRFVRLLIVNDSSSALIAGKPAECLRVLERLGGRLPPMPVKQGMIGHCPEVAPYTPGIAHIHEILEIPDSPVKMYTSVTNAELRGGSNSSITEFVQKLYTRIADFPGIVDKVSRDGHDVFVEVGPNNMRSAAVSDILGKAATPHVSVALDRPSESAWTQTLKSLALLTAHRVPLHNPTLFADLYHPTFLTAIDSAMQEPPPKPNRFLRSVEVNGYFCPDGISKQVAAASAKPSTHCMVRLHPAKAVVVAAAGAVVADSTPVVKAKQTSSSLLVGDDAFLRCYDVDWPLYMGAMAEGISSVDLVVAAAEARMLASFGAARLPMDQVELQIREIQQRTSNAFAVNLMPGPDEAATVDALLRTGVSIVEASGYTGALSADLVRYRVTGLRRTSCGASVSATHRVVAKVSRTEVAEHFLRPAPAAVLEALVAAKQITPEQAALASRVAMADDVAVEADSGGHTDNRPIHVLLPLVVAQRNRWRHLVDTPVRVGAGGGIACPRAALLAFSLGAAFVVTGSVNQLAREAGTSDAVRLLLATATYSDVAMAPGGVQVLKKQTMFAARATMLAQLQAKFGSFDAVPEPQLRKLERSVFKQSVADVWAAAREKFGVDATAASPQERMALCVRWYMSQSSRWATEATSARKADYQIWCGPAIGSFNDFVRGTKLDATAGTGEFPRVVDINQHILLGASHYRRVQQQQQDDDVEYIIV

SEQ ID NO: 5 - DNA, 5778 bp, Schizochytrium sp.
atgccgtgcgataacattgcggtcgtgggcatggcggtgcagtatgccggatgcaagaaccaggacgagttctgggatacgctgatgcgtaaggagatcaactcgagcccgatctcggcggagcgcctcggtacgcgctaccgcgacctccacttccacccgcagcgcagcaagtacgccgacaccttctgcaacgatcgctacggctgcgtcgatgccagcgtcgacaacgagcacgacctcctcgccgacctggcccggcgcgccctgctcgacgccggaattaacctcgacgacgccagcaccaccgccaacctacgcgacttcggcatcgtgagcggctgcctgtcgttccccatggacaatctgcagggcgagctgctcaatctgtaccaagtgcatgtggagaaccgcgtgggcgcccagcgcttccgcgactcgcgcccctggtcggagcgcccgcgcgctgtctcgcccgaggccagcgacccgcgcgtgtactccgacccggcgtccttcgtggccaaccagctcggcctggggcccgtgcgctacagcctcgatgcagcctgcgcgtcggcgctgtactgcctcaagctggcgtccgaccacttgctctcgcgcagcgcggacgtgatgctgtgcggcgccacatgctttccggacccgttcttcattctctcggggttctccaccttccaggcgatgccgctgggcggaccggacgataacccactgtccgtgccgctgcggcagggcagccagggcctgacgcccggagagggcggcgccatcatggtgctgaagcgcctcgaggacgccgtgcgcgacggcgaccgcatctacggcaccttgctcggcacgagtctgagcaacgccgggtgcggcctgccgctgagcccgcacctgccgagcgagaagtcgtgcatggaggacctgtacacgagcgtcggcatcgacccaagcgaggtgcagtacgtggagtgccacgccacgggcactccgcagggcgacgtcgtggaggtagaggcgctgcgccactgctttcgaggtaacacggaccacccgccgcgcatgggctccaccaagggcaactttggccacactctcgtggcggccgggttcgcaggcatggccaaggtgctgctgtcgatgcagcacggcacgatcccgcccacgcccggtgtcgaccgctccaactgcatcgacccgctcgtcgtggacgaggccatcccttggccgtactcgtcggcgcaggcgcgggcaggcaaaccaggcgatgagctcaagtgcgcctcgctctccgcctttggctttggtggaaccaacgcgcactgtgtcttccgtgagcaccgccaaattgctgctactgcgacagcctcgccggtgcttcccgaggtgactcctggaccgattgccatcatcgggatggacgcgacgtttggtaccctcaagggcctggacgcgtttgagcaggccatctacaagggcacggacggcgccagcgacctgccgagcaagcgctggcggttcctgggcgccgacacggacttcttgaccgccatgggcctcgacgccgtgccgcgcgggtgctacgtgcgcgacgtggacgtggactacaagcggctgcggtcgccgatgatccctgaggacgtcctgcgcccgcaacagctgctggcggtggctacgatggaccgcgcgctgcaggacgctggaatggcgacgggaggcaaggtggcggtgctggtggggctcggcacggacaccgagctgtaccggcaccgcgcgcgcgtgacactcaaggagcggctcgacccggccgcgttctcgcccgagcaggtgcaggagatgatggactacatcaacgactgcggcacctcgacgtcgtacacgtcgtacatcggcaacctcgtggccacgcgcgtgtcctcgcagtggggctttacgggcccgtccttcaccgtcaccgaaggcgcaaactcggtctaccgctgcctcgagctgggcaagttcctgctcgacacgcaccaggtggacgccgtcgtggtggccggcgtcgacctctgtgccaccgccgagaacctttacctcaaggcgcgccgctccgccatcagccgacaggaccaccctcgcgccaactttgaggccagcgccgacgggtactttgccggcgagggcagcggcgccctggtcctcaagcgccaggccgacgttggctcagacgacaaggtctacgccagtgtcgcgggcctcacgtgcgccgcgcagcccgctgaagccgtgtcgccgctactactccaagtccacaacgacgacaacgagaagagggtggtggagatggtggagctcgccgccgactcgggtcgccatgcgccgcacttggccaactcgccgctgagcgccgagtcgcagctggagcaagtgtccaagttgctcgcgcaccaggtgccgggctcggtggccatcggcagcgtgcgcgccaacgtgggagacgtcgggtacgcctcgggcgccgcgagcctcatcaagacggcgctgtgcctccacaaccgctacctcccggccaacccgcagtgggagcggccggtggcgccggtctccgaggcgctgtttacttgcccgcgctcgcgtgcctggctgaagaacccgggcgagtcgcgactggcggctgtcgccagtgcctccgagagcgggtcctgctttggcgtgctcctcacagacgagtacgccactcatgagagcagcaaccgcctctcgctggatgacgccgcccccaagctcatcgcgatccgtggcgacaccgttgacgatatcatggccaaggtcaacgccgagctggcgctcctccgagcgcacgccgaaaccgggtctgctactgacgacgacccagctgctgctgtcgctttcactgctcatcgcttgcgctttttgcggctcgtaggggagacggtggctagtcacggtgccacggcgaccttgtgtttggccctgctgacaacgccggagaagctggagaaggagttggagctggcagccaagggtgtaccgcgaagcgccaaggccgggcgcaactggatgtcgccatcgggcagcgcctttgcgccgacacctgtgaccagcgaccgcgtcgcgttcatgtacggcgagggccgcagcccctactacggcgtcgggctcgacctgcaccgcctgtggccggctttgcacgagcgcatcaacgacaagaccgcggcgctgtgggagaacggcgactcgtggctcatgccgcgcgcggtggatgccgactcgcagcgcgccgtgcagacggcctttgacgcggaccagatcgagatgttccgcacgggcatcttcgtgtccatctgcctcaccgactacgcgcgcgacgtgctcggggtgcagcccaaggcgtgcttcggcctcagcctcggcgagatctccatgctctttgcgctgtcgcgacgcaactgcggcctgtcggaccagctcacgcagcgcctacgcacctcgccggtgtggtcgacacagctggcggtggagttccaggccttgcgcaagctatggaacgtgccggcggacgcccccgtggagtccttctggcagggctacttggttcgcgccagccgcgccgaaatcgagaaggcgatcgggcccgacaaccgcttcgtgcgcctgctgatcgtcaacgactcgagcagcgcgctgatcgccggcaaacctgccgagtgtctgcgcgtgctggagcgcctgggcgggcggttgccgccgatgcccgtcaagcaaggcatgattgggcactgccccgaagtggcgccctacacgccgggcatcgcgcacatccacgagattttggagattccggacagccccgtcaagatgtacacctcggtcaccaacgccgagctgcgcgggggcagcaacagcagcatcaccgagttcgtgcagaagttgtacacgcgcatcgccgactttccgggcatcgtcgacaaggtcagccgtgacggccacgatgtcttcgtcgaggtggggccgaacaacatgcgctccgccgcggtcagtgacattcttggcaaggctgccaccccgcatgtctccgtggcgctggaccgccccagtgagtcggcgtggacgcagaccctcaagtcgctggcgctgctgaccgcccaccgcgtgcccctgcacaacccgactctgtttgcggacctgtaccaccccacgttcctgacggctatcgactctgcgatgcaggagcccccgcccaagcccaaccgcttccttcgcagcgtagaggtcaacgggtacttttgccccgacggcatcagcaagcaggttgctgctgcaagtgccaaaccctcgacgcattgcatggttcgtttgcacccagccaaggcagttgtggttgctgctgctggtgctgtggttgctgattcgacgcccgtggtcaaggccaagcagacgtcgtcgtcgttgttggttggggatgacgcctttctgcgctgctacgacgtggactggccgctctacatgggcgccatggcggaaggcatctcgtcggtagacctggtggtcgctgccgccgaggcccgcatgctggcatcattcggagcggcccgcttgcctatggaccaggtggaactccagatccgtgagatccagcaacgcacctccaacgcctttgctgtcaacctgatgccgggtcctgacgaggccgcgacggtggacgcgctgctgcgcacgggcgtctcaatcgtcgaggcatcgggctacaccggcgcgctctctgcagacctggtgcgctaccgtgtcacgggtctgcgacgaactagttgcggtgcttctgtgtcggcgactcaccgtgtggtcgccaaggtgtcgcgcaccgaggtggccgagcactttctgcgcccggcgccggccgccgtactagaggctttggtcgccgccaaacagattacgcccgagcaggccgcgctggccagccgcgtcgccatggccgacgacgtcgcggtggaggccgactcgggcgggcacaccgacaaccgaccgatccacgtgctgctgccgctcgtggtggcgcagcgcaaccgctggcgccacctggtggacacgccagtgcgcgtcggcgccggcggcgggatcgcctgtccgcgcgccgcgctgctcgccttttccctgggcgccgcctttgtggtcaccgggtccgtcaaccaactggcccgcgaggctggcaccagcgacgcggtccgactactgctggcgacggccacctactcggacgtggccatggcgccgggcggcgtccaggtgctcaagaagcagaccatgttcgccgcgcgggccacgatgctcgcccagctgcaggccaagttcggctcctttgacgccgtgccggagccgcagctgcgcaagctcgagcgctccgtgttcaagcagtccgtggcggacgtgtgggctgctgcacgcgaaaagtttggtgtcgacgctaccgctgcaagtccgcaggagaggatggcgctctgtgtgcgctggtacatgtcgcagtcgtcgcgatgggctaccgaggcgacgtccgcgcgcaaggcggactaccagatctggtgcggccccgccatcggcagcttcaacgacttcgttcgcggcaccaagctggacgcgaccgctggcaccggcgagtttccgcgcgtcgtggacatcaaccagcacatcctcctcggagcctcgcactaccgccgcgtgcagcaacaacaacaggacgacgacgtagaatacatcatcgtataa

SEQ ID NO: 6 - DNA, 5778 bp, Artificial Sequence
  Plant optimized PUFA synthase PFA2
atgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttga

SEQ ID NO: 7 - protein, 1435 aa, Schizochytrium sp.
MTSSKKTPVWEMSKEELLDGKTVVFDYNELLEFAEGDVGQVFGPEFDIIDKYRRRVRLPAREYLLVSRVTLMDAEVNNFRVGSRMVTEYDVPVNGELSEGGDVPWAVLVESGQCDLMLISYMGIDFQCKGDRVYRLLNTSLTFFGVAHEGETLVYDIRVTGFAKGAGGEISMFFFEYDCFVDGRLLIEMRDGCAGFFTDAELAAGKGVLKTKAELAARAQIQKQDIAPFAPAPCSHKTSLDAREMRLLVDRQWARVFGSGMAGIDYKLCARKMLMIDRVTHLDPRGGAHGLGLLIGEKVLERDHWYFPCHFVRDEVMAGSLVSDGCSQLLKVYMLWLGLHTTVGAFDFRPVSGHANKVRCRGQISPHKGKLVYVMEIKEMGFDAKTGDPFAIADVDIIDVNFEEGQAFAGVEDLHSYGQGDLRKKIVVDFKGIALSLQKRKEQQKESMTVTTTTTTTSRVIAPPSGCLKGDPTAPTSVTWHPMAEGNGGPGPTPSFSPSAYPPRAVCFSPFPNNPLDNDHTPGQMPLTWFNMSEFMCGKVSNCLGPEFARFDASKTSRSPAFDLALVTRVTSVADMEHGPFYNVDVNPGQGTMVGEFDCPADAWFFGASSRDDHMPYSILMEIALQTSGVLTSVLKAPLTMDKDDILFRNLDADAELVGDAMPDVRGKTIRNFTKCTGYSMLGKMGIHRFTFELSVDGAVFYKGSTSFGWFVPEVFESQTGLDNGKPRLPWYRENNVAVDTLSAPASASSAQGQLQLQRRGSQAQFLDTIHLAGSGAGVHGQGYAHGEKAVNKQDWFFSCHFWFDPVMPGSLGIESMFQLVEAWCVKQGLAARHGIAHPVFAHAPGATSWKYRGQLTPKNDRMDSEVHIKSVAAFSSWVDVVADGFLFVDGLRVYSADNLRVRIQTGAGHVEEQEVAAKATTKNSSIADVDVADLQALKQALLTLERPLQLDAGSEVPACAVSDLGDRGFMETYGVVAPLYSGAMAKGIASADLVIAMGQRKMLGSFGAGGLPMHVVRAGIEKIQAALPAGPYAVNLIHSPFDANLEKGNVDLFLEKGVRVVEASAFMELTPQVVRYRATGLSRDARGGSVRTAHKIIGKVSRTELAEMFIRPAPQAILDKLVASGEITPEQAALALEVPMADDIAVEADSGGHTDNRPIHVILPLILSLRNRLQRELKYPARHRVRVGAGGGIGCPQAALGAFHMGAAFVVTGTVNQLSRQAGTCDNVRRQLSRATYSDITMAPAADMFEQGVELQVLKKGTMFPSRAKKLFELFHKYDSFEAMPADELARVEKRIFSKSLAEVWAETKDFYITRLNNPEKIRKAENEDPKLKMSLCFRWYLGLSSFWANNGIADRTMDYQIWCGPAIGAFNDFIADSYLDVAVSGEFPDVVQINLQILSGAAYLQRLLSVKLAPRIDVDTEDDLFTYRPDHAL

SEQ ID NO: 8 - DNA, 4308 bp, Schizochytrium sp.
atgacatcatcgaagaagactcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaa

SEQ ID NO: 9 - DNA, 4308 bp, Artificial Sequence
  Plant-optimized PUFA synthase PFA3
atgacatcttcaaagaaaactcctgtttgggaaatgagcaaggaagagctgttggatggcaagacggttgtctttgactacaacgagctgttggagtttgcggagggtgatgttggtcaagtgtttggaccagagtttgacatcattgacaagtacagaaggcgtgtgaggcttccagccagagaatacttgcttgtttcaagagtgactctcatggatgccgaggtgaataacttcagagttggctccagaatggtcactgagtatgatgttccagtcaatggtgagttgtcagagggaggtgatgttccctgggcagttcttgttgaaagtgggcagtgtgacttgatgctcatctcctacatggggattgacttccagtgcaaaggggaccgtgtttacagattgctcaacacatctctcaccttctttggggttgcccatgaaggagaaacccttgtgtatgacatcagagtcactggtttcgccaagggtgctggtggggaaatctcaatgttctttttcgagtatgactgctttgttgatggcagattgctcatagagatgagagatggttgtgctggcttctttactgatgccgaacttgccgctggaaaaggtgtgctcaaaacgaaggctgagcttgctgcacgtgctcagatccagaaacaagacattgcaccctttgcacctgcaccgtgcagtcacaaaaccagcttggatgccagagaaatgagactgcttgttgataggcaatgggcaagggtctttggttctggaatggctggcatagactacaagttgtgtgcgagaaagatgctgatgattgacagagtcacacaccttgatccgcgtggaggtgctcacggtcttgggcttctcattggggagaaagtgcttgagagggaccactggtacttcccctgccactttgtgagggatgaggtcatggctggttctcttgtctcagatggatgctctcagcttctcaaggtttacatgttgtggcttggccttcacaccactgttggtgcgttcgactttcgtccagtcagtggtcatgccaacaaagtgaggtgtcgtggacagatttcaccgcacaaggggaaacttgtttatgtcatggagatcaaagaaatgggctttgatgccaaaactggagatccatttgccatagctgatgttgacatcattgatgtcaactttgaagagggacaagcgtttgctggagttgaggatcttcacagctatggccaaggagatttgaggaaaaagatagttgtggatttcaagggaattgcgttgtcactgcagaaaaggaaggagcaacagaaagagagcatgactgtcaccactacgaccacgacaaccagcagagtgattgctcctccaagtggatgcctcaaaggtgatcccactgctcccacctctgtcacgtggcatccaatggctgagggaaatggaggtcctggacccactccgtccttctctccttcagcgtatcctcccagagctgtttgcttctctcctttccccaacaatccgcttgacaatgatcatacacctggccaaatgccgttgacctggttcaacatgtctgagttcatgtgtggaaaagtgagcaactgcttgggtcctgagtttgccagatttgatgcttccaagacatccagatcaccagcttttgacctggctcttgtgacaagggtgacgagtgtggctgacatggaacatggtcctttctacaatgtggatgtcaaccctggccaaggcacgatggtgggtgagtttgattgtcctgcagatgcttggttctttggagcctcaagcagagacgatcacatgccgtacagcatcttgatggagattgctcttcagacttctggagtcctcacatctgtgctcaaagctccgctcacaatggacaaagatgacatccttttcagaaaccttgatgcagatgcagaacttgtgggtgatgccatgcctgatgtcagagggaaaaccataaggaacttcaccaaatgcacgggatactccatgcttggcaagatgggaatccatcgtttcaccttcgaactctctgttgacggagcagttttctacaaagggagcacctcttttggttggtttgttcctgaggtctttgagagccagactggattggacaatggcaagccgaggttgccttggtatagggaaaacaatgtggcagtggacacactctcagcacctgcgtcagcttctagtgcccaaggtcagcttcagcttcagaggagagggtcacaagcgcagttcctggacacaattcatcttgctgggagtggagctggagtgcatggccaaggttatgctcatggggagaaagctgtgaacaagcaagattggttcttttcttgccatttctggtttgacccagtgatgcctgggtctttgggaattgagtccatgttccagcttgtggaagcgtggtgtgtcaaacaaggcttggctgcaaggcatggaattgctcatccagtctttgcacatgcacctggtgccaccagctggaagtacagaggtcagttgaccccaaagaatgacagaatggacagtgaagttcacatcaagagtgttgctgccttctcctcatgggttgatgtggttgctgatgggttcctcttcgttgatggcctcagagtctattcagcagacaacctgagggtcagaatccagactggagctggccatgttgaagagcaagaagttgctgccaaagccaccacaaagaactccagcattgctgatgtggatgtggctgatcttcaagctctcaaacaagcgttgctgacactggagagaccattgcagttggatgctggaagtgaggtgccagcctgtgctgtcagcgatttgggagaccgtggattcatggagacttatggggtggttgctccgttgtacagtggtgcgatggccaagggaatagcctctgcggatctggtcatagcaatgggtcagaggaagatgttggggagctttggagctggtgggttgccaatgcacgttgtccgtgctgggattgaaaagatccaagctgcacttcccgctggtccgtatgctgtcaacctcatccactcaccgttcgatgccaacctggaaaagggcaatgttgatcttttcctggaaaagggagttcgtgtggttgaggcgtctgccttcatggaactcacaccacaagtggtccgttacagagccacgggactctccagagatgcgagaggtggctcagtgaggacagcacacaagatcataggaaaggtttccagaacagagcttgcggagatgttcatcagacctgcacctcaagcaattctggacaaacttgttgcgtctggtgaaatcacccctgagcaagctgcgttggctcttgaagttccaatggctgatgacattgcagttgaggctgacagtggagggcacactgacaaccgtcccattcatgtcattctgccgttgatcctcagtctgaggaataggctccagagggaactcaagtaccctgccagacaccgtgttagggttggtgctggtggaggcataggttgtcctcaagctgcacttggagccttccacatgggagctgcgtttgttgtgactggcactgtcaaccagctgtcccgtcaagctggaacatgtgacaacgtgaggcgtcagctctctcgtgccacttactctgacatcacgatggcaccagctgcagacatgtttgaacaaggagttgaactgcaagttctcaagaaaggaacgatgttcccatctcgtgccaagaaactctttgaactgttccacaagtatgattcctttgaagcaatgcctgcggatgaattggctcgtgttgagaagaggatcttctccaagtcccttgcagaagtttgggcagagaccaaagatttctacatcactcgtctcaacaatcctgaaaagatcagaaaggctgagaatgaggaccccaagctcaagatgtccctctgcttccgttggtacttgggtctcagctcattctgggcaaacaatggcatagctgaccgtacgatggattaccagatttggtgtggacctgccataggagccttcaacgatttcattgcagacagctatcttgatgttgcagtctctggtgagttccctgatgttgtgcagatcaaccttcaaatcctgtctggtgctgcgtatctccagagattgctcagtgtcaaacttgcaccaaggatagatgtggacactgaagatgacctcttcacctacagaccagatcatgcactctga

SEQ ID NO: 10 - DNA, 714 bp, Nostoc sp.
atgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactga

SEQ ID NO: 11 - DNA, 2346 bp, Schizochytrium sp.
atggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcatgacgccgtctccatttttggctttaactcgcccgaatggtttctcagtgccgtcggcgccgtgcacgcaggtgccaagattgccggcatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtccgagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactatggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctccttcaagggcgactttagcatgattggcgacgatgatccggatcttcaaaacgtcgatgtcctcgaggcgattgacgaggacaattaa

SEQ ID NO: 12 - DNA, 996 bp, Artificial Sequence
  Artificial spacer sequence
gttatcgaacaagacatctataagccctaagccaatgtccccgattcctggaatcatctcgtcatgtcccccgcttgcactttagctgagcatgtagaaagtacgtacgcgacttcatccttacttgatgatcgccccaagtatcctagttaagaacctcatatcctctgcaaagtgtgattctacgcttgggttatcgaccaccctgaagagcgttatcgcacttttttcaacagaagtacgccaattctcaatggcacgcactctgaacggctcactggggtcagtttgtatggcccttgagcacgctcgtaagcgcgggaagcggctactcccccagattacgaagcaagcgtaacggggatattgatcatggtgactatctgatgtttagattcaatagcccccatagttttcaaatgcgtacttttagtcacccctgggaatctcgcctgggacctggtgatgtaaaggtttcgcactttcgtttctgtgttgtccctatctacgatgaagtaatacgtagtggcacgcgtgatttgtaaagtgaaaactcactaagggttccaacatgtgagttaataaacctcttcacgaccctacgttgacatccaaaactacaatatcttacatcatacaacgctgatctattacgtttcacgagacggaggttgtgagggaatcgtaactggtgtcactcgctgtggctcatgtcgattcattttgctaataaaccacgtaatgagtattggctgatcacaaagctgagtgtactaccaaatcagagatcaacttgcatagcaattttcgacgatttgcaagttgccgacccgtgtactcgtaatgctagcttccaaagtgacacttatctacgaacaagtcaatatctgagggagaatggttattgactcgtaaattagaaaagtcatcgcaagttaaaagtcaacggcccaagagatcgcgatgccgtgcctaatccaaggctgtagagtagtc

SEQ ID NO: 13 - DNA, 4275 bp, Schizochytrium sp.
atgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaa

SEQ ID NO: 14 - protein, 1424 aa, Artificial Sequence
  Truncated PFA3
MSKEELLDGKTVVFDYNELLEFAEGDVGQVFGPEFDIIDKYRRRVRLPAREYLLVSRVTLMDAEVNNFRVGSRMVTEYDVPVNGELSEGGDVPWAVLVESGQCDLMLISYMGIDFQCKGDRVYRLLNTSLTFFGVAHEGETLVYDIRVTGFAKGAGGEISMFFFEYDCFVDGRLLIEMRDGCAGFFTDAELAAGKGVLKTKAELAARAQIQKQDIAPFAPAPCSHKTSLDAREMRLLVDRQWARVFGSGMAGIDYKLCARKMLMIDRVTHLDPRGGAHGLGLLIGEKVLERDHWYFPCHFVRDEVMAGSLVSDGCSQLLKVYMLWLGLHTTVGAFDFRPVSGHANKVRCRGQISPHKGKLVYVMEIKEMGFDAKTGDPFAIADVDIIDVNFEEGQAFAGVEDLHSYGQGDLRKKIVVDFKGIALSLQKRKEQQKESMTVTTTTTTTSRVIAPPSGCLKGDPTAPTSVTWHPMAEGNGGPGPTPSFSPSAYPPRAVCFSPFPNNPLDNDHTPGQMPLTWFNMSEFMCGKVSNCLGPEFARFDASKTSRSPAFDLALVTRVTSVADMEHGPFYNVDVNPGQGTMVGEFDCPADAWFFGASSRDDHMPYSILMEIALQTSGVLTSVLKAPLTMDKDDILFRNLDADAELVGDAMPDVRGKTIRNFTKCTGYSMLGKMGIHRFTFELSVDGAVFYKGSTSFGWFVPEVFESQTGLDNGKPRLPWYRENNVAVDTLSAPASASSAQGQLQLQRRGSQAQFLDTIHLAGSGAGVHGQGYAHGEKAVNKQDWFFSCHFWFDPVMPGSLGIESMFQLVEAWCVKQGLAARHGIAHPVFAHAPGATSWKYRGQLTPKNDRMDSEVHIKSVAAFSSWVDVVADGFLFVDGLRVYSADNLRVRIQTGAGHVEEQEVAAKATTKNSSIADVDVADLQALKQALLTLERPLQLDAGSEVPACAVSDLGDRGFMETYGVVAPLYSGAMAKGIASADLVIAMGQRKMLGSFGAGGLPMHVVRAGIEKIQAALPAGPYAVNLIHSPFDANLEKGNVDLFLEKGVRVVEASAFMELTPQVVRYRATGLSRDARGGSVRTAHKIIGKVSRTELAEMFIRPAPQAILDKLVASGEITPEQAALALEVPMADDIAVEADSGGHTDNRPIHVILPLILSLRNRLQRELKYPARHRVRVGAGGGIGCPQAALGAFHMGAAFVVTGTVNQLSRQAGTCDNVRRQLSRATYSDITMAPAADMFEQGVELQVLKKGTMFPSRAKKLFELFHKYDSFEAMPADELARVEKRIFSKSLAEVWAETKDFYITRLNNPEKIRKAENEDPKLKMSLCFRWYLGLSSFWANNGIADRTMDYQIWCGPAIGAFNDFIADSYLDVAVSGEFPDVVQINLQILSGAAYLQRLLSVKLAPRIDVDTEDDLFTYRPDHAL

SEQ ID NO: 15 - DNA, 37281 bp, Artificial Sequence
  Plasmid pDAB101429
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcttcaaagaaaactcctgtttgggaaatgagcaaggaagagctgttggatggcaagacggttgtctttgactacaacgagctgttggagtttgcggagggtgatgttggtcaagtgtttggaccagagtttgacatcattgacaagtacagaaggcgtgtgaggcttccagccagagaatacttgcttgtttcaagagtgactctcatggatgccgaggtgaataacttcagagttggctccagaatggtcactgagtatgatgttccagtcaatggtgagttgtcagagggaggtgatgttccctgggcagttcttgttgaaagtgggcagtgtgacttgatgctcatctcctacatggggattgacttccagtgcaaaggggaccgtgtttacagattgctcaacacatctctcaccttctttggggttgcccatgaaggagaaacccttgtgtatgacatcagagtcactggtttcgccaagggtgctggtggggaaatctcaatgttctttttcgagtatgactgctttgttgatggcagattgctcatagagatgagagatggttgtgctggcttctttactgatgccgaacttgccgctggaaaaggtgtgctcaaaacgaaggctgagcttgctgcacgtgctcagatccagaaacaagacattgcaccctttgcacctgcaccgtgcagtcacaaaaccagcttggatgccagagaaatgagactgcttgttgataggcaatgggcaagggtctttggttctggaatggctggcatagactacaagttgtgtgcgagaaagatgctgatgattgacagagtcacacaccttgatccgcgtggaggtgctcacggtcttgggcttctcattggggagaaagtgcttgagagggaccactggtacttcccctgccactttgtgagggatgaggtcatggctggttctcttgtctcagatggatgctctcagcttctcaaggtttacatgttgtggcttggccttcacaccactgttggtgcgttcgactttcgtccagtcagtggtcatgccaacaaagtgaggtgtcgtggacagatttcaccgcacaaggggaaacttgtttatgtcatggagatcaaagaaatgggctttgatgccaaaactggagatccatttgccatagctgatgttgacatcattgatgtcaactttgaagagggacaagcgtttgctggagttgaggatcttcacagctatggccaaggagatttgaggaaaaagatagttgtggatttcaagggaattgcgttgtcactgcagaaaaggaaggagcaacagaaagagagcatgactgtcaccactacgaccacgacaaccagcagagtgattgctcctccaagtggatgcctcaaaggtgatcccactgctcccacctctgtcacgtggcatccaatggctgagggaaatggaggtcctggacccactccgtccttctctccttcagcgtatcctcccagagctgtttgcttctctcctttccccaacaatccgcttgacaatgatcatacacctggccaaatgccgttgacctggttcaacatgtctgagttcatgtgtggaaaagtgagcaactgcttgggtcctgagtttgccagatttgatgcttccaagacatccagatcaccagcttttgacctggctcttgtgacaagggtgacgagtgtggctgacatggaacatggtcctttctacaatgtggatgtcaaccctggccaaggcacgatggtgggtgagtttgattgtcctgcagatgcttggttctttggagcctcaagcagagacgatcacatgccgtacagcatcttgatggagattgctcttcagacttctggagtcctcacatctgtgctcaaagctccgctcacaatggacaaagatgacatccttttcagaaaccttgatgcagatgcagaacttgtgggtgatgccatgcctgatgtcagagggaaaaccataaggaacttcaccaaatgcacgggatactccatgcttggcaagatgggaatccatcgtttcaccttcgaactctctgttgacggagcagttttctacaaagggagcacctcttttggttggtttgttcctgaggtctttgagagccagactggattggacaatggcaagccgaggttgccttggtatagggaaaacaatgtggcagtggacacactctcagcacctgcgtcagcttctagtgcccaaggtcagcttcagcttcagaggagagggtcacaagcgcagttcctggacacaattcatcttgctgggagtggagctggagtgcatggccaaggttatgctcatggggagaaagctgtgaacaagcaagattggttcttttcttgccatttctggtttgacccagtgatgcctgggtctttgggaattgagtccatgttccagcttgtggaagcgtggtgtgtcaaacaaggcttggctgcaaggcatggaattgctcatccagtctttgcacatgcacctggtgccaccagctggaagtacagaggtcagttgaccccaaagaatgacagaatggacagtgaagttcacatcaagagtgttgctgccttctcctcatgggttgatgtggttgctgatgggttcctcttcgttgatggcctcagagtctattcagcagacaacctgagggtcagaatccagactggagctggccatgttgaagagcaagaagttgctgccaaagccaccacaaagaactccagcattgctgatgtggatgtggctgatcttcaagctctcaaacaagcgttgctgacactggagagaccattgcagttggatgctggaagtgaggtgccagcctgtgctgtcagcgatttgggagaccgtggattcatggagacttatggggtggttgctccgttgtacagtggtgcgatggccaagggaatagcctctgcggatctggtcatagcaatgggtcagaggaagatgttggggagctttggagctggtgggttgccaatgcacgttgtccgtgctgggattgaaaagatccaagctgcacttcccgctggtccgtatgctgtcaacctcatccactcaccgttcgatgccaacctggaaaagggcaatgttgatcttttcctggaaaagggagttcgtgtggttgaggcgtctgccttcatggaactcacaccacaagtggtccgttacagagccacgggactctccagagatgcgagaggtggctcagtgaggacagcacacaagatcataggaaaggtttccagaacagagcttgcggagatgttcatcagacctgcacctcaagcaattctggacaaacttgttgcgtctggtgaaatcacccctgagcaagctgcgttggctcttgaagttccaatggctgatgacattgcagttgaggctgacagtggagggcacactgacaaccgtcccattcatgtcattctgccgttgatcctcagtctgaggaataggctccagagggaactcaagtaccctgccagacaccgtgttagggttggtgctggtggaggcataggttgtcctcaagctgcacttggagccttccacatgggagctgcgtttgttgtgactggcactgtcaaccagctgtcccgtcaagctggaacatgtgacaacgtgaggcgtcagctctctcgtgccacttactctgacatcacgatggcaccagctgcagacatgtttgaacaaggagttgaactgcaagttctcaagaaaggaacgatgttcccatctcgtgccaagaaactctttgaactgttccacaagtatgattcctttgaagcaatgcctgcggatgaattggctcgtgttgagaagaggatcttctccaagtcccttgcagaagtttgggcagagaccaaagatttctacatcactcgtctcaacaatcctgaaaagatcagaaaggctgagaatgaggaccccaagctcaagatgtccctctgcttccgttggtacttgggtctcagctcattctgggcaaacaatggcatagctgaccgtacgatggattaccagatttggtgtggacctgccataggagccttcaacgatttcattgcagacagctatcttgatgttgcagtctctggtgagttccctgatgttgtgcagatcaaccttcaaatcctgtctggtgctgcgtatctccagagattgctcagtgtcaaacttgcaccaaggatagatgtggacactgaagatgacctcttcacctacagaccagatcatgcactctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 16 - DNA, 33672 bp, Artificial Sequence
  Plasmid pDAB101454
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcttcaaagaaaactcctgtttgggaaatgagcaaggaagagctgttggatggcaagacggttgtctttgactacaacgagctgttggagtttgcggagggtgatgttggtcaagtgtttggaccagagtttgacatcattgacaagtacagaaggcgtgtgaggcttccagccagagaatacttgcttgtttcaagagtgactctcatggatgccgaggtgaataacttcagagttggctccagaatggtcactgagtatgatgttccagtcaatggtgagttgtcagagggaggtgatgttccctgggcagttcttgttgaaagtgggcagtgtgacttgatgctcatctcctacatggggattgacttccagtgcaaaggggaccgtgtttacagattgctcaacacatctctcaccttctttggggttgcccatgaaggagaaacccttgtgtatgacatcagagtcactggtttcgccaagggtgctggtggggaaatctcaatgttctttttcgagtatgactgctttgttgatggcagattgctcatagagatgagagatggttgtgctggcttctttactgatgccgaacttgccgctggaaaaggtgtgctcaaaacgaaggctgagcttgctgcacgtgctcagatccagaaacaagacattgcaccctttgcacctgcaccgtgcagtcacaaaaccagcttggatgccagagaaatgagactgcttgttgataggcaatgggcaagggtctttggttctggaatggctggcatagactacaagttgtgtgcgagaaagatgctgatgattgacagagtcacacaccttgatccgcgtggaggtgctcacggtcttgggcttctcattggggagaaagtgcttgagagggaccactggtacttcccctgccactttgtgagggatgaggtcatggctggttctcttgtctcagatggatgctctcagcttctcaaggtttacatgttgtggcttggccttcacaccactgttggtgcgttcgactttcgtccagtcagtggtcatgccaacaaagtgaggtgtcgtggacagatttcaccgcacaaggggaaacttgtttatgtcatggagatcaaagaaatgggctttgatgccaaaactggagatccatttgccatagctgatgttgacatcattgatgtcaactttgaagagggacaagcgtttgctggagttgaggatcttcacagctatggccaaggagatttgaggaaaaagatagttgtggatttcaagggaattgcgttgtcactgcagaaaaggaaggagcaacagaaagagagcatgactgtcaccactacgaccacgacaaccagcagagtgattgctcctccaagtggatgcctcaaaggtgatcccactgctcccacctctgtcacgtggcatccaatggctgagggaaatggaggtcctggacccactccgtccttctctccttcagcgtatcctcccagagctgtttgcttctctcctttccccaacaatccgcttgacaatgatcatacacctggccaaatgccgttgacctggttcaacatgtctgagttcatgtgtggaaaagtgagcaactgcttgggtcctgagtttgccagatttgatgcttccaagacatccagatcaccagcttttgacctggctcttgtgacaagggtgacgagtgtggctgacatggaacatggtcctttctacaatgtggatgtcaaccctggccaaggcacgatggtgggtgagtttgattgtcctgcagatgcttggttctttggagcctcaagcagagacgatcacatgccgtacagcatcttgatggagattgctcttcagacttctggagtcctcacatctgtgctcaaagctccgctcacaatggacaaagatgacatccttttcagaaaccttgatgcagatgcagaacttgtgggtgatgccatgcctgatgtcagagggaaaaccataaggaacttcaccaaatgcacgggatactccatgcttggcaagatgggaatccatcgtttcaccttcgaactctctgttgacggagcagttttctacaaagggagcacctcttttggttggtttgttcctgaggtctttgagagccagactggattggacaatggcaagccgaggttgccttggtatagggaaaacaatgtggcagtggacacactctcagcacctgcgtcagcttctagtgcccaaggtcagcttcagcttcagaggagagggtcacaagcgcagttcctggacacaattcatcttgctgggagtggagctggagtgcatggccaaggttatgctcatggggagaaagctgtgaacaagcaagattggttcttttcttgccatttctggtttgacccagtgatgcctgggtctttgggaattgagtccatgttccagcttgtggaagcgtggtgtgtcaaacaaggcttggctgcaaggcatggaattgctcatccagtctttgcacatgcacctggtgccaccagctggaagtacagaggtcagttgaccccaaagaatgacagaatggacagtgaagttcacatcaagagtgttgctgccttctcctcatgggttgatgtggttgctgatgggttcctcttcgttgatggcctcagagtctattcagcagacaacctgagggtcagaatccagactggagctggccatgttgaagagcaagaagttgctgccaaagccaccacaaagaactccagcattgctgatgtggatgtggctgatcttcaagctctcaaacaagcgttgctgacactggagagaccattgcagttggatgctggaagtgaggtgccagcctgtgctgtcagcgatttgggagaccgtggattcatggagacttatggggtggttgctccgttgtacagtggtgcgatggccaagggaatagcctctgcggatctggtcatagcaatgggtcagaggaagatgttggggagctttggagctggtgggttgccaatgcacgttgtccgtgctgggattgaaaagatccaagctgcacttcccgctggtccgtatgctgtcaacctcatccactcaccgttcgatgccaacctggaaaagggcaatgttgatcttttcctggaaaagggagttcgtgtggttgaggcgtctgccttcatggaactcacaccacaagtggtccgttacagagccacgggactctccagagatgcgagaggtggctcagtgaggacagcacacaagatcataggaaaggtttccagaacagagcttgcggagatgttcatcagacctgcacctcaagcaattctggacaaacttgttgcgtctggtgaaatcacccctgagcaagctgcgttggctcttgaagttccaatggctgatgacattgcagttgaggctgacagtggagggcacactgacaaccgtcccattcatgtcattctgccgttgatcctcagtctgaggaataggctccagagggaactcaagtaccctgccagacaccgtgttagggttggtgctggtggaggcataggttgtcctcaagctgcacttggagccttccacatgggagctgcgtttgttgtgactggcactgtcaaccagctgtcccgtcaagctggaacatgtgacaacgtgaggcgtcagctctctcgtgccacttactctgacatcacgatggcaccagctgcagacatgtttgaacaaggagttgaactgcaagttctcaagaaaggaacgatgttcccatctcgtgccaagaaactctttgaactgttccacaagtatgattcctttgaagcaatgcctgcggatgaattggctcgtgttgagaagaggatcttctccaagtcccttgcagaagtttgggcagagaccaaagatttctacatcactcgtctcaacaatcctgaaaagatcagaaaggctgagaatgaggaccccaagctcaagatgtccctctgcttccgttggtacttgggtctcagctcattctgggcaaacaatggcatagctgaccgtacgatggattaccagatttggtgtggacctgccataggagccttcaacgatttcattgcagacagctatcttgatgttgcagtctctggtgagttccctgatgttgtgcagatcaaccttcaaatcctgtctggtgctgcgtatctccagagattgctcagtgtcaaacttgcaccaaggatagatgtggacactgaagatgacctcttcacctacagaccagatcatgcactctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 17 - DNA, 34011 bp, Artificial Sequence
  Plasmid pDAB101496
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcatcgaagaagatcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 18 - DNA, 33668 bp, Artificial Sequence
  Plasmid pDAB109525
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggatactcgcatcgcgatcgtggggatgtcggcgatcctgccgagcggggagaacgtgcgcgagagctgggaggcgatccgcgatgggctggattgcctgagcgatctgccggcggaccgcgtggacgtgacggcctactacaacccggagaagacgaccaaggacaagatctactgcaagcgcggcgggttcatcccggagtacgacttcgacgcgcgtgagttcgggctcaacatgttccagatggaggactcggacgccaaccagacgatctcgctgctcaaggtgaaggaggcgctgacggacgccaacatcccggcgttctcgagcggtaagaagaacatcggctgcgtgctgggcatcggcggcggccagaaggcgagccacgagttctactcgcggctcaactacgtggtcgtggacaaggtgctgcgcaagatgggcctgccggaggaagacgtggcggcggcggtggacaagtacaaggcgagtttccccgagtggcgcctcgactctttccccgggttcctgggcaacgtcacggcggggcgctgctgcaataccttcaacatggagggcatgaactgcgtcgtggacgcggcctgcgcgtcgtcgctgatcgcggtcaaagtggcgatcgaggagctgctctacggcgactgcgatgcgatgatcgcgggtgccacctgcacggacaactcgatcgggatgtacatggccttctccaagacgcccgtgttttccacggacccgagcgtcaaggcgtacgacgccgccaccaaaggcatgctcatcggcgagggctcggcgatgctcgtgctgaagcgctacgcggacgccgtgcgcgacggcgacaccgtgcacgccgtcatcaaggggtgcgcgtcctcgagcgacggcaaggcggcgggcatctacacgccgacaatctcgggccaggaggaggccctgcgccgcgcctacgcccgcgccaatgtcgacccggccactgtgacgctggtggagggccacggcacgggtacgccggtgggcgacaagatcgagctgacggcgctgagcaacctcttctccaaggcgttttctgccaacggtggcggcgcggaggaagcagagcaggtggcggtgggcagcatcaagtcgcagatcgggcacctcaaggcggtggccgggctggccgggctggtcaaggtggtgctggcgctcaagcacaagacgctgccgcagacgatcaacgtcgacaagccgccgtcgctggtggacgggaccccgatccagcagtcgccgctgtacgtcaacacgatgaaccgcccctggttcacgcccgtaggggtgccgcgccgcgccggcgtgtcgtcgtttgggtttggcggtgccaactaccacgccgtgctggaggagtttgagcccgagcacgagagcgcgtaccggtacaacaacctgccgcaggtggcgctgctgcacgcgggggacgtcgcgaccttggcggcgacggttcgcgccaagctggcgctggccaccgccgagcaggaagaggcgcgtgtggtgaagaacgcggactacatcgcgtaccaccggttcctggacgagtgcaagttgcgcggcgctgtgccgcaggcgcacgcgcgggtgggactgctcgtacgggacctgagctcgctcatcgccgtgctcgaggccgctgccgccaagctcgcgggcgaagagagcgcgacggagtggacggtcagcgttgctacgggcgaggcggccttccgcgtgcgcggtgtggctacggaggccaacgtggcggcgctgttctcgggccagggcgcgcagtacacgcacatgttcagcgacgtggcgatgaactggcccccgttccgcgagagcgtcgccgccatggaccgcgcccagcgcgagcgcttcgggcggcctgccaagcgcgtgagcagcgtgctgtacccgcgcaagccgtacggcgacgaaccgcggcaggaccacaaggagatctcgcaaacgcgctactcgcagcccgcaacgctcgcgtgctcggtcggcgcctttgacatcttcaaagcggcgggactggcgccgagctttgcggcgggccactcgctgggcgagtttgcggcgctctacgcggccgggtcgctcgatcgcgacgccgtcttcgacctggtctgcgcgcgcgccaaggccatgagcgacttcacggcccaggccagcagcagcggtggcgccatggcggccgtgattggcgccaaggcggaccagctctcgctgggtggcgcgcccgacgtgtggctcgccaacagcaactcgccctcgcagaccgtgatcacgggaaccgccgaagcagtggctgcggcctctgacaagttgcgctgcagcggcaacttccgcgtcgtgcctctggcctgcgaggcggccttccactcgccgcacatgcgcggcgcggagcagacgtttgcgtcggcgctcgcgcaggcgcccgtgtcggcaccggcggctgctcggttctactctaacgtgacggggggcgccgcggtaacctcgcccgcggacgtcaaaacgaacctgggcaagcacatgacgagccctgtgcagttcgtgcagcaggtgcgagccatgcacgcggcgggcgcgcgtgtgtttgtggagtttgggcccaagcaggtcctgtcgcgcctcgtcaaggagacccttggcgaggccggcgacgtggtcacggtcgccgtcaacccagactcggccaaggacagcgacacgcagctgcgccaggcggcgctcacgttggcggtcgccggcgtgccgctcaaggactttgaccgctggcagctgccggatgccacgcgcctcgagcctgtcaagaagaagaagaccacgttgcggctctcggcagccacctacgtctccgccaagacgttgcgccagcgcgaggccgtgctcaacgacggctacactgtcagtggtgccacggcggtagtcaaggaagtggacacggccaacgaggagcgtctcgtccgccaagcccaggatctccagcgccagctcgcggaggcctcgacggcagcccaggcggcgcagtccaaggtcgcggagctcgagcgcacgatccaggacttggagcgcaaggtgcagcagcagcagcaagagaagggtgagaactcagacagcaacgctgccgccgaagtgctgcggcgccacaaggagctgctccagcgcatgctgcaggactgtgacgagcaggcagtgcccgtagccacggtggttccgacacctacgtcctccccgacgcctacatcctcacccgtatccggcaacagcaagagcactcgtggcagtgctgatctgcaagcgctgctggccaaggcggagactgtggtgatggctgtgctggctgccaagactggctacgaggccgacatggttgaggcggacatggacctggaggccgagctcggcatcgactcgatcaagcgcgtggagatcctttccgaggtgcagggccagctgggcgtcgaggccaaggacgtggatgcgctgagccgcacgcgcacggtcggtgaggttgtggacgccatgaaggcggagatcgtggctgcctctggtggtagtgctcctgcggttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctgctggtagtgctcctgctcctgctgttccttcggcgcccgctgcttctgcagctccgactcccgctgcttcgactgcgccttctgctgatctgcaagcgctgctgtccaaggcggagacggtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctcctgcggttccttcggcgcccgctgcttctgcagctccgactcccgcggctgcgacagcgccttctgctgatctgcaagcgctgctggccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaggttgtggatgccatgaaggcggagatcgtggctgcctctgctggtagtgctcctgctcctgctgttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctgctgctgttccttcggcgcccgctgcttctgcagctccgactcctgcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaagtggtggacgccatgaaggcggagatcgtggctgcctctggtggtagtgctcctgctgctccttcggcgcccgcgcttcttccaacgctgtttggttccgagtgcgaggacctgtctctgacctttcccgtgataacgaccctgccgcttcctgcagagcttgtgctggccgagggcggcgctcgccctgtagtcgtggtggatgatggatctgcactcacctcgtcgctggtgtcctcgctcggcgatcgtgcggtgctgctgcaggtgcagtcttcctctgcctgctcgccgcgctcgaccacgcacaagttggtgaccgtagcagaccgctctgaagcggcgctacaggcggcgctcacgtccgtcgaggcgcagttcggcaaggtgggtggctttgtgttccagttcggcgacgacgacgtgcaagcgcagctcggctgggcgctgctcgcggccaagcacctcaaaacttcgctgtcagaacagatcgagggcggtcgcacctttttcgtggccgtcgcgcggctcgacggccagctggggctctccggcaagtcgacgaccgctaccgttgatctctcccgcgcgcagcagggcagcgtgttcggcctgtgcaagacactcgacctggagtggcccgctgtcttctgccgcggaatcgacctggccgccgacctcgacgccgcacaggccgcgcggtgcctgctgggcgagctgtcagaccccgacgtggccgtgcgcgagtctggttactccgcctcgggccagcgctgcacgacaactacgaagtcgctgactacgggcaagccgcaccagccgatctcctcgtcggacctctttctggtgtcgggcggcgcgcgcggcatcaccccgctgtgcgtgcgcgagctggcgcagcgcgtgggcggcggcacgtacgtgctcatcggccgctcggagctgcccacgacggagcctgcctgggcggtcggcgtggagtctggcaagccgctggagaaggccgcgctggcgttcctgaaggcggagtttgcagcgggccgcggggccaagccgacgccgatgctgcacaagaagctcgtgggcgccgtggtcggagcgcgcgaggtgcgagcctcgctcgccgagatcactgcacagggcgccacggctgtgtacgagtcgtgcgacgtgagctctgccgccaaggtgcgtgagatggtagagcgcgtgcagcagcagggcgggcggcgcgtgtcgggcgtgttccacgcgtcgggcgtgctgcgcgacaagctcgtggagaacaagtcgctggcggacttcagcgccgtgtacgacaccaaggtgggcggcctcatcaacctgctggcctgcgtggacctggcgcagctgcgtcacctcgtgctcttcagctcgctcgcgggcttccacggcaacgtcgggcagtcggactacgcaatggccaacgaggcgctcaacaagctggcggcgcacctgtcggcggtgcacccgcagctgtgcgcgcgctcgatctgcttcggaccgtgggacggcggcatggtgacccccgcgctcaaggccaacttcatccgcatgggcatccagatcatcccgcgccaaggcggcgcgcagaccgtcgccaacatgctcgtcagtagctcccccggtcagctgctcgtgggcaactggggcgtgccacccgtcgtgccgagtgccaccgagcacaccgtgctgcagacgctccgccagagcgacaaccccttcctcgactcgcacgtgatccagggccgccgcgtgctgcccatgaccctggccgtgggctacatggcgcaccaggcgcagagcatctacgcgggccaccagctgtgggccgtcgaggacgcccagctcttcaagggcatcgccatcgacaatggcgccgacgtgcccgtgcgcgtggagctgtcgcgccgcaaggaggagcaggaggacgccggcaaggtcaaggtcaaggtgcaggtgctgctcaaatcgcaggtcaacggcaagtcggtgcccgcgtacaaggcgaccgtcgtgctgtcccctgcgccgcgccccagcgtcatcacgcgtgacttcgacctcaccccggacccggcctgcacggagcacgacctctacgacggcaagacgctcttccacggcaaggccttccagggcatcgagcaggtgctctcggcgacgcccaagcagctcaccgccaagtgccgcaatttgcccctcacgcccgagcagcgcggccagttcgtcgttaacctcagccagcaggacccgttccaggcggacattgcgttccaggcgatgctcgtctgggcgcgcatgctgcgccaatcggcggccctgcccaacaactgcgagcgcttcgacttttacaagccgatggccccgggcgccacctactacacgtcggtcaagctggcctcggcctcacccttggtggactctgtgtgcaagtgcaccgtggcgatgcacgatgagcaaggtgaggtgtacttttctgctcgtgccagcgtcgtcctcaacaagaccctcacgtactaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgccgtgcgataacattgcggtcgtgggcatggcggtgcagtatgccggatgcaagaaccaggacgagttctgggatacgctgatgcgtaaggagatcaactcgagcccgatctcggcggagcgcctcggtacgcgctaccgcgacctccacttccacccgcagcgcagcaagtacgccgacaccttctgcaacgatcgctacggctgcgtcgatgccagcgtcgacaacgagcacgacctcctcgccgacctggcccggcgcgccctgctcgacgccggaattaacctcgacgacgccagcaccaccgccaacctacgcgacttcggcatcgtgagcggctgcctgtcgttccccatggacaatctgcagggcgagctgctcaatctgtaccaagtgcatgtggagaaccgcgtgggcgcccagcgcttccgcgactcgcgcccctggtcggagcgcccgcgcgctgtctcgcccgaggccagcgacccgcgcgtgtactccgacccggcgtccttcgtggccaaccagctcggcctggggcccgtgcgctacagcctcgatgcagcctgcgcgtcggcgctgtactgcctcaagctggcgtccgaccacttgctctcgcgcagcgcggacgtgatgctgtgcggcgccacatgctttccggacccgttcttcattctctcggggttctccaccttccaggcgatgccgctgggcggaccggacgataacccactgtccgtgccgctgcggcagggcagccagggcctgacgcccggagagggcggcgccatcatggtgctgaagcgcctcgaggacgccgtgcgcgacggcgaccgcatctacggcaccttgctcggcacgagtctgagcaacgccgggtgcggcctgccgctgagcccgcacctgccgagcgagaagtcgtgcatggaggacctgtacacgagcgtcggcatcgacccaagcgaggtgcagtacgtggagtgccacgccacgggcactccgcagggcgacgtcgtggaggtagaggcgctgcgccactgctttcgaggtaacacggaccacccgccgcgcatgggctccaccaagggcaactttggccacactctcgtggcggccgggttcgcaggcatggccaaggtgctgctgtcgatgcagcacggcacgatcccgcccacgcccggtgtcgaccgctccaactgcatcgacccgctcgtcgtggacgaggccatcccttggccgtactcgtcggcgcaggcgcgggcaggcaaaccaggcgatgagctcaagtgcgcctcgctctccgcctttggctttggtggaaccaacgcgcactgtgtcttccgtgagcaccgccaaattgctgctactgcgacagcctcgccggtgcttcccgaggtgactcctggaccgattgccatcatcgggatggacgcgacgtttggtaccctcaagggcctggacgcgtttgagcaggccatctacaagggcacggacggcgccagcgacctgccgagcaagcgctggcggttcctgggcgccgacacggacttcttgaccgccatgggcctcgacgccgtgccgcgcgggtgctacgtgcgcgacgtggacgtggactacaagcggctgcggtcgccgatgatccctgaggacgtcctgcgcccgcaacagctgctggcggtggctacgatggaccgcgcgctgcaggacgctggaatggcgacgggaggcaaggtggcggtgctggtggggctcggcacggacaccgagctgtaccggcaccgcgcgcgcgtgacactcaaggagcggctcgacccggccgcgttctcgcccgagcaggtgcaggagatgatggactacatcaacgactgcggcacctcgacgtcgtacacgtcgtacatcggcaacctcgtggccacgcgcgtgtcctcgcagtggggctttacgggcccgtccttcaccgtcaccgaaggcgcaaactcggtctaccgctgcctcgagctgggcaagttcctgctcgacacgcaccaggtggacgccgtcgtggtggccggcgtcgacctctgtgccaccgccgagaacctttacctcaaggcgcgccgctccgccatcagccgacaggaccaccctcgcgccaactttgaggccagcgccgacgggtactttgccggcgagggcagcggcgccctggtcctcaagcgccaggccgacgttggctcagacgacaaggtctacgccagtgtcgcgggcctcacgtgcgccgcgcagcccgctgaagccgtgtcgccgctactactccaagtccacaacgacgacaacgagaagagggtggtggagatggtggagctcgccgccgactcgggtcgccatgcgccgcacttggccaactcgccgctgagcgccgagtcgcagctggagcaagtgtccaagttgctcgcgcaccaggtgccgggctcggtggccatcggcagcgtgcgcgccaacgtgggagacgtcgggtacgcctcgggcgccgcgagcctcatcaagacggcgctgtgcctccacaaccgctacctcccggccaacccgcagtgggagcggccggtggcgccggtctccgaggcgctgtttacttgcccgcgctcgcgtgcctggctgaagaacccgggcgagtcgcgactggcggctgtcgccagtgcctccgagagcgggtcctgctttggcgtgctcctcacagacgagtacgccactcatgagagcagcaaccgcctctcgctggatgacgccgcccccaagctcatcgcgatccgtggcgacaccgttgacgatatcatggccaaggtcaacgccgagctggcgctcctccgagcgcacgccgaaaccgggtctgctactgacgacgacccagctgctgctgtcgctttcactgctcatcgcttgcgctttttgcggctcgtaggggagacggtggctagtcacggtgccacggcgaccttgtgtttggccctgctgacaacgccggagaagctggagaaggagttggagctggcagccaagggtgtaccgcgaagcgccaaggccgggcgcaactggatgtcgccatcgggcagcgcctttgcgccgacacctgtgaccagcgaccgcgtcgcgttcatgtacggcgagggccgcagcccctactacggcgtcgggctcgacctgcaccgcctgtggccggctttgcacgagcgcatcaacgacaagaccgcggcgctgtgggagaacggcgactcgtggctcatgccgcgcgcggtggatgccgactcgcagcgcgccgtgcagacggcctttgacgcggaccagatcgagatgttccgcacgggcatcttcgtgtccatctgcctcaccgactacgcgcgcgacgtgctcggggtgcagcccaaggcgtgcttcggcctcagcctcggcgagatctccatgctctttgcgctgtcgcgacgcaactgcggcctgtcggaccagctcacgcagcgcctacgcacctcgccggtgtggtcgacacagctggcggtggagttccaggccttgcgcaagctatggaacgtgccggcggacgcccccgtggagtccttctggcagggctacttggttcgcgccagccgcgccgaaatcgagaaggcgatcgggcccgacaaccgcttcgtgcgcctgctgatcgtcaacgactcgagcagcgcgctgatcgccggcaaacctgccgagtgtctgcgcgtgctggagcgcctgggcgggcggttgccgccgatgcccgtcaagcaaggcatgattgggcactgccccgaagtggcgccctacacgccgggcatcgcgcacatccacgagattttggagattccggacagccccgtcaagatgtacacctcggtcaccaacgccgagctgcgcgggggcagcaacagcagcatcaccgagttcgtgcagaagttgtacacgcgcatcgccgactttccgggcatcgtcgacaaggtcagccgtgacggccacgatgtcttcgtcgaggtggggccgaacaacatgcgctccgccgcggtcagtgacattcttggcaaggctgccaccccgcatgtctccgtggcgctggaccgccccagtgagtcggcgtggacgcagaccctcaagtcgctggcgctgctgaccgcccaccgcgtgcccctgcacaacccgactctgtttgcggacctgtaccaccccacgttcctgacggctatcgactctgcgatgcaggagcccccgcccaagcccaaccgcttccttcgcagcgtagaggtcaacgggtacttttgccccgacggcatcagcaagcaggttgctgctgcaagtgccaaaccctcgacgcattgcatggttcgtttgcacccagccaaggcagttgtggttgctgctgctggtgctgtggttgctgattcgacgcccgtggtcaaggccaagcagacgtcgtcgtcgttgttggttggggatgacgcctttctgcgctgctacgacgtggactggccgctctacatgggcgccatggcggaaggcatctcgtcggtagacctggtggtcgctgccgccgaggcccgcatgctggcatcattcggagcggcccgcttgcctatggaccaggtggaactccagatccgtgagatccagcaacgcacctccaacgcctttgctgtcaacctgatgccgggtcctgacgaggccgcgacggtggacgcgctgctgcgcacgggcgtctcaatcgtcgaggcatcgggctacaccggcgcgctctctgcagacctggtgcgctaccgtgtcacgggtctgcgacgaactagttgcggtgcttctgtgtcggcgactcaccgtgtggtcgccaaggtgtcgcgcaccgaggtggccgagcactttctgcgcccggcgccggccgccgtactagaggctttggtcgccgccaaacagattacgcccgagcaggccgcgctggccagccgcgtcgccatggccgacgacgtcgcggtggaggccgactcgggcgggcacaccgacaaccgaccgatccacgtgctgctgccgctcgtggtggcgcagcgcaaccgctggcgccacctggtggacacgccagtgcgcgtcggcgccggcggcgggatcgcctgtccgcgcgccgcgctgctcgccttttccctgggcgccgcctttgtggtcaccgggtccgtcaaccaactggcccgcgaggctggcaccagcgacgcggtccgactactgctggcgacggccacctactcggacgtggccatggcgccgggcggcgtccaggtgctcaagaagcagaccatgttcgccgcgcgggccacgatgctcgcccagctgcaggccaagttcggctcctttgacgccgtgccggagccgcagctgcgcaagctcgagcgctccgtgttcaagcagtccgtggcggacgtgtgggctgctgcacgcgaaaagtttggtgtcgacgctaccgctgcaagtccgcaggagaggatggcgctctgtgtgcgctggtacatgtcgcagtcgtcgcgatgggctaccgaggcgacgtccgcgcgcaaggcggactaccagatctggtgcggccccgccatcggcagcttcaacgacttcgttcgcggcaccaagctggacgcgaccgctggcaccggcgagtttccgcgcgtcgtggacatcaaccagcacatcctcctcggagcctcgcactaccgccgcgtgcagcaacaacaacaggacgacgacgtagaatacatcatcgtataagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcatcgaagaagatcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagcttt

SEQ ID NO: 19 - DNA, 35570 bp, Artificial Sequence
  Plasmid pDAB109584
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcatcgaagaagatcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctagggcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccttttagtattaagagaagaaccaaaggctttgttgttttcataatctttctgtcattttcttttattatgatgtcaagtcaagcgactctttggtagtaatctgtatgccatggatctctctctctatttgtcgactgaaaacttttgggttacacatgaaagctttttctttttctaaaatccaaaatgaaagagttgtattaacagatacataagtgaaagagtagtccctaagatgacactagcttcatttataaacaatcctatcacattgtatatacaggttatgatttattcccaatcagcgtcaaagaatccagcatctttcatctctgaatagtagacattctccaagtttagatcttcctcctcgatcaaagcggccgcttaattaaactagtgctagcctcgaggtcgacacccagcttt

SEQ ID NO: 20 - DNA, 36453 bp, Artificial Sequence
  Plasmid pDAB109588
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcttcaaagaaaactcctgtttgggaaatgagcaaggaagagctgttggatggcaagacggttgtctttgactacaacgagctgttggagtttgcggagggtgatgttggtcaagtgtttggaccagagtttgacatcattgacaagtacagaaggcgtgtgaggcttccagccagagaatacttgcttgtttcaagagtgactctcatggatgccgaggtgaataacttcagagttggctccagaatggtcactgagtatgatgttccagtcaatggtgagttgtcagagggaggtgatgttccctgggcagttcttgttgaaagtgggcagtgtgacttgatgctcatctcctacatggggattgacttccagtgcaaaggggaccgtgtttacagattgctcaacacatctctcaccttctttggggttgcccatgaaggagaaacccttgtgtatgacatcagagtcactggtttcgccaagggtgctggtggggaaatctcaatgttctttttcgagtatgactgctttgttgatggcagattgctcatagagatgagagatggttgtgctggcttctttactgatgccgaacttgccgctggaaaaggtgtgctcaaaacgaaggctgagcttgctgcacgtgctcagatccagaaacaagacattgcaccctttgcacctgcaccgtgcagtcacaaaaccagcttggatgccagagaaatgagactgcttgttgataggcaatgggcaagggtctttggttctggaatggctggcatagactacaagttgtgtgcgagaaagatgctgatgattgacagagtcacacaccttgatccgcgtggaggtgctcacggtcttgggcttctcattggggagaaagtgcttgagagggaccactggtacttcccctgccactttgtgagggatgaggtcatggctggttctcttgtctcagatggatgctctcagcttctcaaggtttacatgttgtggcttggccttcacaccactgttggtgcgttcgactttcgtccagtcagtggtcatgccaacaaagtgaggtgtcgtggacagatttcaccgcacaaggggaaacttgtttatgtcatggagatcaaagaaatgggctttgatgccaaaactggagatccatttgccatagctgatgttgacatcattgatgtcaactttgaagagggacaagcgtttgctggagttgaggatcttcacagctatggccaaggagatttgaggaaaaagatagttgtggatttcaagggaattgcgttgtcactgcagaaaaggaaggagcaacagaaagagagcatgactgtcaccactacgaccacgacaaccagcagagtgattgctcctccaagtggatgcctcaaaggtgatcccactgctcccacctctgtcacgtggcatccaatggctgagggaaatggaggtcctggacccactccgtccttctctccttcagcgtatcctcccagagctgtttgcttctctcctttccccaacaatccgcttgacaatgatcatacacctggccaaatgccgttgacctggttcaacatgtctgagttcatgtgtggaaaagtgagcaactgcttgggtcctgagtttgccagatttgatgcttccaagacatccagatcaccagcttttgacctggctcttgtgacaagggtgacgagtgtggctgacatggaacatggtcctttctacaatgtggatgtcaaccctggccaaggcacgatggtgggtgagtttgattgtcctgcagatgcttggttctttggagcctcaagcagagacgatcacatgccgtacagcatcttgatggagattgctcttcagacttctggagtcctcacatctgtgctcaaagctccgctcacaatggacaaagatgacatccttttcagaaaccttgatgcagatgcagaacttgtgggtgatgccatgcctgatgtcagagggaaaaccataaggaacttcaccaaatgcacgggatactccatgcttggcaagatgggaatccatcgtttcaccttcgaactctctgttgacggagcagttttctacaaagggagcacctcttttggttggtttgttcctgaggtctttgagagccagactggattggacaatggcaagccgaggttgccttggtatagggaaaacaatgtggcagtggacacactctcagcacctgcgtcagcttctagtgcccaaggtcagcttcagcttcagaggagagggtcacaagcgcagttcctggacacaattcatcttgctgggagtggagctggagtgcatggccaaggttatgctcatggggagaaagctgtgaacaagcaagattggttcttttcttgccatttctggtttgacccagtgatgcctgggtctttgggaattgagtccatgttccagcttgtggaagcgtggtgtgtcaaacaaggcttggctgcaaggcatggaattgctcatccagtctttgcacatgcacctggtgccaccagctggaagtacagaggtcagttgaccccaaagaatgacagaatggacagtgaagttcacatcaagagtgttgctgccttctcctcatgggttgatgtggttgctgatgggttcctcttcgttgatggcctcagagtctattcagcagacaacctgagggtcagaatccagactggagctggccatgttgaagagcaagaagttgctgccaaagccaccacaaagaactccagcattgctgatgtggatgtggctgatcttcaagctctcaaacaagcgttgctgacactggagagaccattgcagttggatgctggaagtgaggtgccagcctgtgctgtcagcgatttgggagaccgtggattcatggagacttatggggtggttgctccgttgtacagtggtgcgatggccaagggaatagcctctgcggatctggtcatagcaatgggtcagaggaagatgttggggagctttggagctggtgggttgccaatgcacgttgtccgtgctgggattgaaaagatccaagctgcacttcccgctggtccgtatgctgtcaacctcatccactcaccgttcgatgccaacctggaaaagggcaatgttgatcttttcctggaaaagggagttcgtgtggttgaggcgtctgccttcatggaactcacaccacaagtggtccgttacagagccacgggactctccagagatgcgagaggtggctcagtgaggacagcacacaagatcataggaaaggtttccagaacagagcttgcggagatgttcatcagacctgcacctcaagcaattctggacaaacttgttgcgtctggtgaaatcacccctgagcaagctgcgttggctcttgaagttccaatggctgatgacattgcagttgaggctgacagtggagggcacactgacaaccgtcccattcatgtcattctgccgttgatcctcagtctgaggaataggctccagagggaactcaagtaccctgccagacaccgtgttagggttggtgctggtggaggcataggttgtcctcaagctgcacttggagccttccacatgggagctgcgtttgttgtgactggcactgtcaaccagctgtcccgtcaagctggaacatgtgacaacgtgaggcgtcagctctctcgtgccacttactctgacatcacgatggcaccagctgcagacatgtttgaacaaggagttgaactgcaagttctcaagaaaggaacgatgttcccatctcgtgccaagaaactctttgaactgttccacaagtatgattcctttgaagcaatgcctgcggatgaattggctcgtgttgagaagaggatcttctccaagtcccttgcagaagtttgggcagagaccaaagatttctacatcactcgtctcaacaatcctgaaaagatcagaaaggctgagaatgaggaccccaagctcaagatgtccctctgcttccgttggtacttgggtctcagctcattctgggcaaacaatggcatagctgaccgtacgatggattaccagatttggtgtggacctgccataggagccttcaacgatttcattgcagacagctatcttgatgttgcagtctctggtgagttccctgatgttgtgcagatcaaccttcaaatcctgtctggtgctgcgtatctccagagattgctcagtgtcaaacttgcaccaaggatagatgtggacactgaagatgacctcttcacctacagaccagatcatgcactctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgaatatcgacaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaactactgtcactgaggccgtagacgagtacggactgatctaactagtgctagcctcgaggtcgacacccagcttt

SEQ ID NO: 21 - DNA, 33639 bp, Artificial Sequence
  Plasmid pDAB112210
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggatactcgcatcgcgatcgtggggatgtcggcgatcctgccgagcggggagaacgtgcgcgagagctgggaggcgatccgcgatgggctggattgcctgagcgatctgccggcggaccgcgtggacgtgacggcctactacaacccggagaagacgaccaaggacaagatctactgcaagcgcggcgggttcatcccggagtacgacttcgacgcgcgtgagttcgggctcaacatgttccagatggaggactcggacgccaaccagacgatctcgctgctcaaggtgaaggaggcgctgacggacgccaacatcccggcgttctcgagcggtaagaagaacatcggctgcgtgctgggcatcggcggcggccagaaggcgagccacgagttctactcgcggctcaactacgtggtcgtggacaaggtgctgcgcaagatgggcctgccggaggaagacgtggcggcggcggtggacaagtacaaggcgagtttccccgagtggcgcctcgactctttccccgggttcctgggcaacgtcacggcggggcgctgctgcaataccttcaacatggagggcatgaactgcgtcgtggacgcggcctgcgcgtcgtcgctgatcgcggtcaaagtggcgatcgaggagctgctctacggcgactgcgatgcgatgatcgcgggtgccacctgcacggacaactcgatcgggatgtacatggccttctccaagacgcccgtgttttccacggacccgagcgtcaaggcgtacgacgccgccaccaaaggcatgctcatcggcgagggctcggcgatgctcgtgctgaagcgctacgcggacgccgtgcgcgacggcgacaccgtgcacgccgtcatcaaggggtgcgcgtcctcgagcgacggcaaggcggcgggcatctacacgccgacaatctcgggccaggaggaggccctgcgccgcgcctacgcccgcgccaatgtcgacccggccactgtgacgctggtggagggccacggcacgggtacgccggtgggcgacaagatcgagctgacggcgctgagcaacctcttctccaaggcgttttctgccaacggtggcggcgcggaggaagcagagcaggtggcggtgggcagcatcaagtcgcagatcgggcacctcaaggcggtggccgggctggccgggctggtcaaggtggtgctggcgctcaagcacaagacgctgccgcagacgatcaacgtcgacaagccgccgtcgctggtggacgggaccccgatccagcagtcgccgctgtacgtcaacacgatgaaccgcccctggttcacgcccgtaggggtgccgcgccgcgccggcgtgtcgtcgtttgggtttggcggtgccaactaccacgccgtgctggaggagtttgagcccgagcacgagagcgcgtaccggtacaacaacctgccgcaggtggcgctgctgcacgcgggggacgtcgcgaccttggcggcgacggttcgcgccaagctggcgctggccaccgccgagcaggaagaggcgcgtgtggtgaagaacgcggactacatcgcgtaccaccggttcctggacgagtgcaagttgcgcggcgctgtgccgcaggcgcacgcgcgggtgggactgctcgtacgggacctgagctcgctcatcgccgtgctcgaggccgctgccgccaagctcgcgggcgaagagagcgcgacggagtggacggtcagcgttgctacgggcgaggcggccttccgcgtgcgcggtgtggctacggaggccaacgtggcggcgctgttctcgggccagggcgcgcagtacacgcacatgttcagcgacgtggcgatgaactggcccccgttccgcgagagcgtcgccgccatggaccgcgcccagcgcgagcgcttcgggcggcctgccaagcgcgtgagcagcgtgctgtacccgcgcaagccgtacggcgacgaaccgcggcaggaccacaaggagatctcgcaaacgcgctactcgcagcccgcaacgctcgcgtgctcggtcggcgcctttgacatcttcaaagcggcgggactggcgccgagctttgcggcgggccactcgctgggcgagtttgcggcgctctacgcggccgggtcgctcgatcgcgacgccgtcttcgacctggtctgcgcgcgcgccaaggccatgagcgacttcacggcccaggccagcagcagcggtggcgccatggcggccgtgattggcgccaaggcggaccagctctcgctgggtggcgcgcccgacgtgtggctcgccaacagcaactcgccctcgcagaccgtgatcacgggaaccgccgaagcagtggctgcggcctctgacaagttgcgctgcagcggcaacttccgcgtcgtgcctctggcctgcgaggcggccttccactcgccgcacatgcgcggcgcggagcagacgtttgcgtcggcgctcgcgcaggcgcccgtgtcggcaccggcggctgctcggttctactctaacgtgacggggggcgccgcggtaacctcgcccgcggacgtcaaaacgaacctgggcaagcacatgacgagccctgtgcagttcgtgcagcaggtgcgagccatgcacgcggcgggcgcgcgtgtgtttgtggagtttgggcccaagcaggtcctgtcgcgcctcgtcaaggagacccttggcgaggccggcgacgtggtcacggtcgccgtcaacccagactcggccaaggacagcgacacgcagctgcgccaggcggcgctcacgttggcggtcgccggcgtgccgctcaaggactttgaccgctggcagctgccggatgccacgcgcctcgagcctgtcaagaagaagaagaccacgttgcggctctcggcagccacctacgtctccgccaagacgttgcgccagcgcgaggccgtgctcaacgacggctacactgtcagtggtgccacggcggtagtcaaggaagtggacacggccaacgaggagcgtctcgtccgccaagcccaggatctccagcgccagctcgcggaggcctcgacggcagcccaggcggcgcagtccaaggtcgcggagctcgagcgcacgatccaggacttggagcgcaaggtgcagcagcagcagcaagagaagggtgagaactcagacagcaacgctgccgccgaagtgctgcggcgccacaaggagctgctccagcgcatgctgcaggactgtgacgagcaggcagtgcccgtagccacggtggttccgacacctacgtcctccccgacgcctacatcctcacccgtatccggcaacagcaagagcactcgtggcagtgctgatctgcaagcgctgctggccaaggcggagactgtggtgatggctgtgctggctgccaagactggctacgaggccgacatggttgaggcggacatggacctggaggccgagctcggcatcgactcgatcaagcgcgtggagatcctttccgaggtgcagggccagctgggcgtcgaggccaaggacgtggatgcgctgagccgcacgcgcacggtcggtgaggttgtggacgccatgaaggcggagatcgtggctgcctctggtggtagtgctcctgcggttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctgctggtagtgctcctgctcctgctgttccttcggcgcccgctgcttctgcagctccgactcccgctgcttcgactgcgccttctgctgatctgcaagcgctgctgtccaaggcggagacggtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctcctgcggttccttcggcgcccgctgcttctgcagctccgactcccgcggctgcgacagcgccttctgctgatctgcaagcgctgctggccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaggttgtggatgccatgaaggcggagatcgtggctgcctctgctggtagtgctcctgctcctgctgttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctgctgctgttccttcggcgcccgctgcttctgcagctccgactcctgcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaagtggtggacgccatgaaggcggagatcgtggctgcctctggtggtagtgctcctgctgctccttcggcgcccgcgcttcttccaacgctgtttggttccgagtgcgaggacctgtctctgacctttcccgtgataacgaccctgccgcttcctgcagagcttgtgctggccgagggcggcgctcgccctgtagtcgtggtggatgatggatctgcactcacctcgtcgctggtgtcctcgctcggcgatcgtgcggtgctgctgcaggtgcagtcttcctctgcctgctcgccgcgctcgaccacgcacaagttggtgaccgtagcagaccgctctgaagcggcgctacaggcggcgctcacgtccgtcgaggcgcagttcggcaaggtgggtggctttgtgttccagttcggcgacgacgacgtgcaagcgcagctcggctgggcgctgctcgcggccaagcacctcaaaacttcgctgtcagaacagatcgagggcggtcgcacctttttcgtggccgtcgcgcggctcgacggccagctggggctctccggcaagtcgacgaccgctaccgttgatctctcccgcgcgcagcagggcagcgtgttcggcctgtgcaagacactcgacctggagtggcccgctgtcttctgccgcggaatcgacctggccgccgacctcgacgccgcacaggccgcgcggtgcctgctgggcgagctgtcagaccccgacgtggccgtgcgcgagtctggttactccgcctcgggccagcgctgcacgacaactacgaagtcgctgactacgggcaagccgcaccagccgatctcctcgtcggacctctttctggtgtcgggcggcgcgcgcggcatcaccccgctgtgcgtgcgcgagctggcgcagcgcgtgggcggcggcacgtacgtgctcatcggccgctcggagctgcccacgacggagcctgcctgggcggtcggcgtggagtctggcaagccgctggagaaggccgcgctggcgttcctgaaggcggagtttgcagcgggccgcggggccaagccgacgccgatgctgcacaagaagctcgtgggcgccgtggtcggagcgcgcgaggtgcgagcctcgctcgccgagatcactgcacagggcgccacggctgtgtacgagtcgtgcgacgtgagctctgccgccaaggtgcgtgagatggtagagcgcgtgcagcagcagggcgggcggcgcgtgtcgggcgtgttccacgcgtcgggcgtgctgcgcgacaagctcgtggagaacaagtcgctggcggacttcagcgccgtgtacgacaccaaggtgggcggcctcatcaacctgctggcctgcgtggacctggcgcagctgcgtcacctcgtgctcttcagctcgctcgcgggcttccacggcaacgtcgggcagtcggactacgcaatggccaacgaggcgctcaacaagctggcggcgcacctgtcggcggtgcacccgcagctgtgcgcgcgctcgatctgcttcggaccgtgggacggcggcatggtgacccccgcgctcaaggccaacttcatccgcatgggcatccagatcatcccgcgccaaggcggcgcgcagaccgtcgccaacatgctcgtcagtagctcccccggtcagctgctcgtgggcaactggggcgtgccacccgtcgtgccgagtgccaccgagcacaccgtgctgcagacgctccgccagagcgacaaccccttcctcgactcgcacgtgatccagggccgccgcgtgctgcccatgaccctggccgtgggctacatggcgcaccaggcgcagagcatctacgcgggccaccagctgtgggccgtcgaggacgcccagctcttcaagggcatcgccatcgacaatggcgccgacgtgcccgtgcgcgtggagctgtcgcgccgcaaggaggagcaggaggacgccggcaaggtcaaggtcaaggtgcaggtgctgctcaaatcgcaggtcaacggcaagtcggtgcccgcgtacaaggcgaccgtcgtgctgtcccctgcgccgcgccccagcgtcatcacgcgtgacttcgacctcaccccggacccggcctgcacggagcacgacctctacgacggcaagacgctcttccacggcaaggccttccagggcatcgagcaggtgctctcggcgacgcccaagcagctcaccgccaagtgccgcaatttgcccctcacgcccgagcagcgcggccagttcgtcgttaacctcagccagcaggacccgttccaggcggacattgcgttccaggcgatgctcgtctgggcgcgcatgctgcgccaatcggcggccctgcccaacaactgcgagcgcttcgacttttacaagccgatggccccgggcgccacctactacacgtcggtcaagctggcctcggcctcacccttggtggactctgtgtgcaagtgcaccgtggcgatgcacgatgagcaaggtgaggtgtacttttctgctcgtgccagcgtcgtcctcaacaagaccctcacgtactaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgccgtgcgataacattgcggtcgtgggcatggcggtgcagtatgccggatgcaagaaccaggacgagttctgggatacgctgatgcgtaaggagatcaactcgagcccgatctcggcggagcgcctcggtacgcgctaccgcgacctccacttccacccgcagcgcagcaagtacgccgacaccttctgcaacgatcgctacggctgcgtcgatgccagcgtcgacaacgagcacgacctcctcgccgacctggcccggcgcgccctgctcgacgccggaattaacctcgacgacgccagcaccaccgccaacctacgcgacttcggcatcgtgagcggctgcctgtcgttccccatggacaatctgcagggcgagctgctcaatctgtaccaagtgcatgtggagaaccgcgtgggcgcccagcgcttccgcgactcgcgcccctggtcggagcgcccgcgcgctgtctcgcccgaggccagcgacccgcgcgtgtactccgacccggcgtccttcgtggccaaccagctcggcctggggcccgtgcgctacagcctcgatgcagcctgcgcgtcggcgctgtactgcctcaagctggcgtccgaccacttgctctcgcgcagcgcggacgtgatgctgtgcggcgccacatgctttccggacccgttcttcattctctcggggttctccaccttccaggcgatgccgctgggcggaccggacgataacccactgtccgtgccgctgcggcagggcagccagggcctgacgcccggagagggcggcgccatcatggtgctgaagcgcctcgaggacgccgtgcgcgacggcgaccgcatctacggcaccttgctcggcacgagtctgagcaacgccgggtgcggcctgccgctgagcccgcacctgccgagcgagaagtcgtgcatggaggacctgtacacgagcgtcggcatcgacccaagcgaggtgcagtacgtggagtgccacgccacgggcactccgcagggcgacgtcgtggaggtagaggcgctgcgccactgctttcgaggtaacacggaccacccgccgcgcatgggctccaccaagggcaactttggccacactctcgtggcggccgggttcgcaggcatggccaaggtgctgctgtcgatgcagcacggcacgatcccgcccacgcccggtgtcgaccgctccaactgcatcgacccgctcgtcgtggacgaggccatcccttggccgtactcgtcggcgcaggcgcgggcaggcaaaccaggcgatgagctcaagtgcgcctcgctctccgcctttggctttggtggaaccaacgcgcactgtgtcttccgtgagcaccgccaaattgctgctactgcgacagcctcgccggtgcttcccgaggtgactcctggaccgattgccatcatcgggatggacgcgacgtttggtaccctcaagggcctggacgcgtttgagcaggccatctacaagggcacggacggcgccagcgacctgccgagcaagcgctggcggttcctgggcgccgacacggacttcttgaccgccatgggcctcgacgccgtgccgcgcgggtgctacgtgcgcgacgtggacgtggactacaagcggctgcggtcgccgatgatccctgaggacgtcctgcgcccgcaacagctgctggcggtggctacgatggaccgcgcgctgcaggacgctggaatggcgacgggaggcaaggtggcggtgctggtggggctcggcacggacaccgagctgtaccggcaccgcgcgcgcgtgacactcaaggagcggctcgacccggccgcgttctcgcccgagcaggtgcaggagatgatggactacatcaacgactgcggcacctcgacgtcgtacacgtcgtacatcggcaacctcgtggccacgcgcgtgtcctcgcagtggggctttacgggcccgtccttcaccgtcaccgaaggcgcaaactcggtctaccgctgcctcgagctgggcaagttcctgctcgacacgcaccaggtggacgccgtcgtggtggccggcgtcgacctctgtgccaccgccgagaacctttacctcaaggcgcgccgctccgccatcagccgacaggaccaccctcgcgccaactttgaggccagcgccgacgggtactttgccggcgagggcagcggcgccctggtcctcaagcgccaggccgacgttggctcagacgacaaggtctacgccagtgtcgcgggcctcacgtgcgccgcgcagcccgctgaagccgtgtcgccgctactactccaagtccacaacgacgacaacgagaagagggtggtggagatggtggagctcgccgccgactcgggtcgccatgcgccgcacttggccaactcgccgctgagcgccgagtcgcagctggagcaagtgtccaagttgctcgcgcaccaggtgccgggctcggtggccatcggcagcgtgcgcgccaacgtgggagacgtcgggtacgcctcgggcgccgcgagcctcatcaagacggcgctgtgcctccacaaccgctacctcccggccaacccgcagtgggagcggccggtggcgccggtctccgaggcgctgtttacttgcccgcgctcgcgtgcctggctgaagaacccgggcgagtcgcgactggcggctgtcgccagtgcctccgagagcgggtcctgctttggcgtgctcctcacagacgagtacgccactcatgagagcagcaaccgcctctcgctggatgacgccgcccccaagctcatcgcgatccgtggcgacaccgttgacgatatcatggccaaggtcaacgccgagctggcgctcctccgagcgcacgccgaaaccgggtctgctactgacgacgacccagctgctgctgtcgctttcactgctcatcgcttgcgctttttgcggctcgtaggggagacggtggctagtcacggtgccacggcgaccttgtgtttggccctgctgacaacgccggagaagctggagaaggagttggagctggcagccaagggtgtaccgcgaagcgccaaggccgggcgcaactggatgtcgccatcgggcagcgcctttgcgccgacacctgtgaccagcgaccgcgtcgcgttcatgtacggcgagggccgcagcccctactacggcgtcgggctcgacctgcaccgcctgtggccggctttgcacgagcgcatcaacgacaagaccgcggcgctgtgggagaacggcgactcgtggctcatgccgcgcgcggtggatgccgactcgcagcgcgccgtgcagacggcctttgacgcggaccagatcgagatgttccgcacgggcatcttcgtgtccatctgcctcaccgactacgcgcgcgacgtgctcggggtgcagcccaaggcgtgcttcggcctcagcctcggcgagatctccatgctctttgcgctgtcgcgacgcaactgcggcctgtcggaccagctcacgcagcgcctacgcacctcgccggtgtggtcgacacagctggcggtggagttccaggccttgcgcaagctatggaacgtgccggcggacgcccccgtggagtccttctggcagggctacttggttcgcgccagccgcgccgaaatcgagaaggcgatcgggcccgacaaccgcttcgtgcgcctgctgatcgtcaacgactcgagcagcgcgctgatcgccggcaaacctgccgagtgtctgcgcgtgctggagcgcctgggcgggcggttgccgccgatgcccgtcaagcaaggcatgattgggcactgccccgaagtggcgccctacacgccgggcatcgcgcacatccacgagattttggagattccggacagccccgtcaagatgtacacctcggtcaccaacgccgagctgcgcgggggcagcaacagcagcatcaccgagttcgtgcagaagttgtacacgcgcatcgccgactttccgggcatcgtcgacaaggtcagccgtgacggccacgatgtcttcgtcgaggtggggccgaacaacatgcgctccgccgcggtcagtgacattcttggcaaggctgccaccccgcatgtctccgtggcgctggaccgccccagtgagtcggcgtggacgcagaccctcaagtcgctggcgctgctgaccgcccaccgcgtgcccctgcacaacccgactctgtttgcggacctgtaccaccccacgttcctgacggctatcgactctgcgatgcaggagcccccgcccaagcccaaccgcttccttcgcagcgtagaggtcaacgggtacttttgccccgacggcatcagcaagcaggttgctgctgcaagtgccaaaccctcgacgcattgcatggttcgtttgcacccagccaaggcagttgtggttgctgctgctggtgctgtggttgctgattcgacgcccgtggtcaaggccaagcagacgtcgtcgtcgttgttggttggggatgacgcctttctgcgctgctacgacgtggactggccgctctacatgggcgccatggcggaaggcatctcgtcggtagacctggtggtcgctgccgccgaggcccgcatgctggcatcattcggagcggcccgcttgcctatggaccaggtggaactccagatccgtgagatccagcaacgcacctccaacgcctttgctgtcaacctgatgccgggtcctgacgaggccgcgacggtggacgcgctgctgcgcacgggcgtctcaatcgtcgaggcatcgggctacaccggcgcgctctctgcagacctggtgcgctaccgtgtcacgggtctgcgacgaactagttgcggtgcttctgtgtcggcgactcaccgtgtggtcgccaaggtgtcgcgcaccgaggtggccgagcactttctgcgcccggcgccggccgccgtactagaggctttggtcgccgccaaacagattacgcccgagcaggccgcgctggccagccgcgtcgccatggccgacgacgtcgcggtggaggccgactcgggcgggcacaccgacaaccgaccgatccacgtgctgctgccgctcgtggtggcgcagcgcaaccgctggcgccacctggtggacacgccagtgcgcgtcggcgccggcggcgggatcgcctgtccgcgcgccgcgctgctcgccttttccctgggcgccgcctttgtggtcaccgggtccgtcaaccaactggcccgcgaggctggcaccagcgacgcggtccgactactgctggcgacggccacctactcggacgtggccatggcgccgggcggcgtccaggtgctcaagaagcagaccatgttcgccgcgcgggccacgatgctcgcccagctgcaggccaagttcggctcctttgacgccgtgccggagccgcagctgcgcaagctcgagcgctccgtgttcaagcagtccgtggcggacgtgtgggctgctgcacgcgaaaagtttggtgtcgacgctaccgctgcaagtccgcaggagaggatggcgctctgtgtgcgctggtacatgtcgcagtcgtcgcgatgggctaccgaggcgacgtccgcgcgcaaggcggactaccagatctggtgcggccccgccatcggcagcttcaacgacttcgttcgcggcaccaagctggacgcgaccgctggcaccggcgagtttccgcgcgtcgtggacatcaaccagcacatcctcctcggagcctcgcactaccgccgcgtgcagcaacaacaacaggacgacgacgtagaatacatcatcgtataagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccatgacatcatcgaagaagactcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagcttt

SEQ ID NO: 22 - DNA, 35500 bp, Artificial Sequence
  Plasmid pDAB112206
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcatcgaagaagatcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaactactgtcactgaggccgtagacgagtacggactgatctaactagtgctagcctcgaggtcgacacccagcttt

SEQ ID NO: 23 - DNA, 36498 bp, Artificial Sequence
  Plasmid pDAB107962
gtacaaaaaagcaggcttctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgacacaactttgtatacaaaagttgtctagacctaggctcagcaactcatccagtcaagttcgagtcagtgagttgggcggccgcgaattcggcgcgccaaccttggactcccatgttggcaaaggcaaccaaacaaacaatgaatgatccgctcctgcatatggggcggtttgagtatttcaactgccatttgggctgaattgaagacatgctcctgtcagaaattccgtgatcttactcaatattcagtaatctcggccaatatcctaaatgtgcgtggctttatctgtctttgtattgtttcatcaattcatgtaacgtttgcttttcttatgaattttcaaataaattatcgatagtactacgaatatttcgtatcgctgatcttctcaatcacaatgatgcgtagtgacccgacaaataatttaagcgtccttaataccaatcctaaaataattgaggcaaataaaatttttttgtaatttttatgatagcagatcgattctccagcaagcctgcaacaaaatattgtgtatttctaaatagattttgatactcgaggtgaccgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcttcaaagaaaactcctgtttgggaaatgagcaaggaagagctgttggatggcaagacggttgtctttgactacaacgagctgttggagtttgcggagggtgatgttggtcaagtgtttggaccagagtttgacatcattgacaagtacagaaggcgtgtgaggcttccagccagagaatacttgcttgtttcaagagtgactctcatggatgccgaggtgaataacttcagagttggctccagaatggtcactgagtatgatgttccagtcaatggtgagttgtcagagggaggtgatgttccctgggcagttcttgttgaaagtgggcagtgtgacttgatgctcatctcctacatggggattgacttccagtgcaaaggggaccgtgtttacagattgctcaacacatctctcaccttctttggggttgcccatgaaggagaaacccttgtgtatgacatcagagtcactggtttcgccaagggtgctggtggggaaatctcaatgttctttttcgagtatgactgctttgttgatggcagattgctcatagagatgagagatggttgtgctggcttctttactgatgccgaacttgccgctggaaaaggtgtgctcaaaacgaaggctgagcttgctgcacgtgctcagatccagaaacaagacattgcaccctttgcacctgcaccgtgcagtcacaaaaccagcttggatgccagagaaatgagactgcttgttgataggcaatgggcaagggtctttggttctggaatggctggcatagactacaagttgtgtgcgagaaagatgctgatgattgacagagtcacacaccttgatccgcgtggaggtgctcacggtcttgggcttctcattggggagaaagtgcttgagagggaccactggtacttcccctgccactttgtgagggatgaggtcatggctggttctcttgtctcagatggatgctctcagcttctcaaggtttacatgttgtggcttggccttcacaccactgttggtgcgttcgactttcgtccagtcagtggtcatgccaacaaagtgaggtgtcgtggacagatttcaccgcacaaggggaaacttgtttatgtcatggagatcaaagaaatgggctttgatgccaaaactggagatccatttgccatagctgatgttgacatcattgatgtcaactttgaagagggacaagcgtttgctggagttgaggatcttcacagctatggccaaggagatttgaggaaaaagatagttgtggatttcaagggaattgcgttgtcactgcagaaaaggaaggagcaacagaaagagagcatgactgtcaccactacgaccacgacaaccagcagagtgattgctcctccaagtggatgcctcaaaggtgatcccactgctcccacctctgtcacgtggcatccaatggctgagggaaatggaggtcctggacccactccgtccttctctccttcagcgtatcctcccagagctgtttgcttctctcctttccccaacaatccgcttgacaatgatcatacacctggccaaatgccgttgacctggttcaacatgtctgagttcatgtgtggaaaagtgagcaactgcttgggtcctgagtttgccagatttgatgcttccaagacatccagatcaccagcttttgacctggctcttgtgacaagggtgacgagtgtggctgacatggaacatggtcctttctacaatgtggatgtcaaccctggccaaggcacgatggtgggtgagtttgattgtcctgcagatgcttggttctttggagcctcaagcagagacgatcacatgccgtacagcatcttgatggagattgctcttcagacttctggagtcctcacatctgtgctcaaagctccgctcacaatggacaaagatgacatccttttcagaaaccttgatgcagatgcagaacttgtgggtgatgccatgcctgatgtcagagggaaaaccataaggaacttcaccaaatgcacgggatactccatgcttggcaagatgggaatccatcgtttcaccttcgaactctctgttgacggagcagttttctacaaagggagcacctcttttggttggtttgttcctgaggtctttgagagccagactggattggacaatggcaagccgaggttgccttggtatagggaaaacaatgtggcagtggacacactctcagcacctgcgtcagcttctagtgcccaaggtcagcttcagcttcagaggagagggtcacaagcgcagttcctggacacaattcatcttgctgggagtggagctggagtgcatggccaaggttatgctcatggggagaaagctgtgaacaagcaagattggttcttttcttgccatttctggtttgacccagtgatgcctgggtctttgggaattgagtccatgttccagcttgtggaagcgtggtgtgtcaaacaaggcttggctgcaaggcatggaattgctcatccagtctttgcacatgcacctggtgccaccagctggaagtacagaggtcagttgaccccaaagaatgacagaatggacagtgaagttcacatcaagagtgttgctgccttctcctcatgggttgatgtggttgctgatgggttcctcttcgttgatggcctcagagtctattcagcagacaacctgagggtcagaatccagactggagctggccatgttgaagagcaagaagttgctgccaaagccaccacaaagaactccagcattgctgatgtggatgtggctgatcttcaagctctcaaacaagcgttgctgacactggagagaccattgcagttggatgctggaagtgaggtgccagcctgtgctgtcagcgatttgggagaccgtggattcatggagacttatggggtggttgctccgttgtacagtggtgcgatggccaagggaatagcctctgcggatctggtcatagcaatgggtcagaggaagatgttggggagctttggagctggtgggttgccaatgcacgttgtccgtgctgggattgaaaagatccaagctgcacttcccgctggtccgtatgctgtcaacctcatccactcaccgttcgatgccaacctggaaaagggcaatgttgatcttttcctggaaaagggagttcgtgtggttgaggcgtctgccttcatggaactcacaccacaagtggtccgttacagagccacgggactctccagagatgcgagaggtggctcagtgaggacagcacacaagatcataggaaaggtttccagaacagagcttgcggagatgttcatcagacctgcacctcaagcaattctggacaaacttgttgcgtctggtgaaatcacccctgagcaagctgcgttggctcttgaagttccaatggctgatgacattgcagttgaggctgacagtggagggcacactgacaaccgtcccattcatgtcattctgccgttgatcctcagtctgaggaataggctccagagggaactcaagtaccctgccagacaccgtgttagggttggtgctggtggaggcataggttgtcctcaagctgcacttggagccttccacatgggagctgcgtttgttgtgactggcactgtcaaccagctgtcccgtcaagctggaacatgtgacaacgtgaggcgtcagctctctcgtgccacttactctgacatcacgatggcaccagctgcagacatgtttgaacaaggagttgaactgcaagttctcaagaaaggaacgatgttcccatctcgtgccaagaaactctttgaactgttccacaagtatgattcctttgaagcaatgcctgcggatgaattggctcgtgttgagaagaggatcttctccaagtcccttgcagaagtttgggcagagaccaaagatttctacatcactcgtctcaacaatcctgaaaagatcagaaaggctgagaatgaggaccccaagctcaagatgtccctctgcttccgttggtacttgggtctcagctcattctgggcaaacaatggcatagctgaccgtacgatggattaccagatttggtgtggacctgccataggagccttcaacgatttcattgcagacagctatcttgatgttgcagtctctggtgagttccctgatgttgtgcagatcaaccttcaaatcctgtctggtgctgcgtatctccagagattgctcagtgtcaaacttgcaccaaggatagatgtggacactgaagatgacctcttcacctacagaccagatcatgcactctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctaggtcgatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtcgacctcgaggctagcactagttagatcagtccgtactcgtctacggcctcagtgacagtagttaattaagcggccgcgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactacttatacgatgatgtattctacgtcgtcgtcctgttgttgttgctgcacgcggcggtagtgcgaggctccgaggaggatgtgctggttgatgtccacgacgcgcggaaactcgccggtgccagcggtcgcgtccagcttggtgccgcgaacgaagtcgttgaagctgccgatggcggggccgcaccagatctggtagtccgccttgcgcgcggacgtcgcctcggtagcccatcgcgacgactgcgacatgtaccagcgcacacagagcgccatcctctcctgcggacttgcagcggtagcgtcgacaccaaacttttcgcgtgcagcagcccacacgtccgccacggactgcttgaacacggagcgctcgagcttgcgcagctgcggctccggcacggcgtcaaaggagccgaacttggcctgcagctgggcgagcatcgtggcccgcgcggcgaacatggtctgcttcttgagcacctggacgccgcccggcgccatggccacgtccgagtaggtggccgtcgccagcagtagtcggaccgcgtcgctggtgccagcctcgcgggccagttggttgacggacccggtgaccacaaaggcggcgcccagggaaaaggcgagcagcgcggcgcgcggacaggcgatcccgccgccggcgccgacgcgcactggcgtgtccaccaggtggcgccagcggttgcgctgcgccaccacgagcggcagcagcacgtggatcggtcggttgtcggtgtgcccgcccgagtcggcctccaccgcgacgtcgtcggccatggcgacgcggctggccagcgcggcctgctcgggcgtaatctgtttggcggcgaccaaagcctctagtacggcggccggcgccgggcgcagaaagtgctcggccacctcggtgcgcgacaccttggcgaccacacggtgagtcgccgacacagaagcaccgcaactagttcgtcgcagacccgtgacacggtagcgcaccaggtctgcagagagcgcgccggtgtagcccgatgcctcgacgattgagacgcccgtgcgcagcagcgcgtccaccgtcgcggcctcgtcaggacccggcatcaggttgacagcaaaggcgttggaggtgcgttgctggatctcacggatctggagttccacctggtccataggcaagcgggccgctccgaatgatgccagcatgcgggcctcggcggcagcgaccaccaggtctaccgacgagatgccttccgccatggcgcccatgtagagcggccagtccacgtcgtagcagcgcagaaaggcgtcatccccaaccaacaacgacgacgacgtctgcttggccttgaccacgggcgtcgaatcagcaaccacagcaccagcagcagcaaccacaactgccttggctgggtgcaaacgaaccatgcaatgcgtcgagggtttggcacttgcagcagcaacctgcttgctgatgccgtcggggcaaaagtacccgttgacctctacgctgcgaaggaagcggttgggcttgggcgggggctcctgcatcgcagagtcgatagccgtcaggaacgtggggtggtacaggtccgcaaacagagtcgggttgtgcaggggcacgcggtgggcggtcagcagcgccagcgacttgagggtctgcgtccacgccgactcactggggcggtccagcgccacggagacatgcggggtggcagccttgccaagaatgtcactgaccgcggcggagcgcatgttgttcggccccacctcgacgaagacatcgtggccgtcacggctgaccttgtcgacgatgcccggaaagtcggcgatgcgcgtgtacaacttctgcacgaactcggtgatgctgctgttgctgcccccgcgcagctcggcgttggtgaccgaggtgtacatcttgacggggctgtccggaatctccaaaatctcgtggatgtgcgcgatgcccggcgtgtagggcgccacttcggggcagtgcccaatcatgccttgcttgacgggcatcggcggcaaccgcccgcccaggcgctccagcacgcgcagacactcggcaggtttgccggcgatcagcgcgctgctcgagtcgttgacgatcagcaggcgcacgaagcggttgtcgggcccgatcgccttctcgatttcggcgcggctggcgcgaaccaagtagccctgccagaaggactccacgggggcgtccgccggcacgttccatagcttgcgcaaggcctggaactccaccgccagctgtgtcgaccacaccggcgaggtgcgtaggcgctgcgtgagctggtccgacaggccgcagttgcgtcgcgacagcgcaaagagcatggagatctcgccgaggctgaggccgaagcacgccttgggctgcaccccgagcacgtcgcgcgcgtagtcggtgaggcagatggacacgaagatgcccgtgcggaacatctcgatctggtccgcgtcaaaggccgtctgcacggcgcgctgcgagtcggcatccaccgcgcgcggcatgagccacgagtcgccgttctcccacagcgccgcggtcttgtcgttgatgcgctcgtgcaaagccggccacaggcggtgcaggtcgagcccgacgccgtagtaggggctgcggccctcgccgtacatgaacgcgacgcggtcgctggtcacaggtgtcggcgcaaaggcgctgcccgatggcgacatccagttgcgcccggccttggcgcttcgcggtacacccttggctgccagctccaactccttctccagcttctccggcgttgtcagcagggccaaacacaaggtcgccgtggcaccgtgactagccaccgtctcccctacgagccgcaaaaagcgcaagcgatgagcagtgaaagcgacagcagcagctgggtcgtcgtcagtagcagacccggtttcggcgtgcgctcggaggagcgccagctcggcgttgaccttggccatgatatcgtcaacggtgtcgccacggatcgcgatgagcttgggggcggcgtcatccagcgagaggcggttgctgctctcatgagtggcgtactcgtctgtgaggagcacgccaaagcaggacccgctctcggaggcactggcgacagccgccagtcgcgactcgcccgggttcttcagccaggcacgcgagcgcgggcaagtaaacagcgcctcggagaccggcgccaccggccgctcccactgcgggttggccgggaggtagcggttgtggaggcacagcgccgtcttgatgaggctcgcggcgcccgaggcgtacccgacgtctcccacgttggcgcgcacgctgccgatggccaccgagcccggcacctggtgcgcgagcaacttggacacttgctccagctgcgactcggcgctcagcggcgagttggccaagtgcggcgcatggcgacccgagtcggcggcgagctccaccatctccaccaccctcttctcgttgtcgtcgttgtggacttggagtagtagcggcgacacggcttcagcgggctgcgcggcgcacgtgaggcccgcgacactggcgtagaccttgtcgtctgagccaacgtcggcctggcgcttgaggaccagggcgccgctgccctcgccggcaaagtacccgtcggcgctggcctcaaagttggcgcgagggtggtcctgtcggctgatggcggagcggcgcgccttgaggtaaaggttctcggcggtggcacagaggtcgacgccggccaccacgacggcgtccacctggtgcgtgtcgagcaggaacttgcccagctcgaggcagcggtagaccgagtttgcgccttcggtgacggtgaaggacgggcccgtaaagccccactgcgaggacacgcgcgtggccacgaggttgccgatgtacgacgtgtacgacgtcgaggtgccgcagtcgttgatgtagtccatcatctcctgcacctgctcgggcgagaacgcggccgggtcgagccgctccttgagtgtcacgcgcgcgcggtgccggtacagctcggtgtccgtgccgagccccaccagcaccgccaccttgcctcccgtcgccattccagcgtcctgcagcgcgcggtccatcgtagccaccgccagcagctgttgcgggcgcaggacgtcctcagggatcatcggcgaccgcagccgcttgtagtccacgtccacgtcgcgcacgtagcacccgcgcggcacggcgtcgaggcccatggcggtcaagaagtccgtgtcggcgcccaggaaccgccagcgcttgctcggcaggtcgctggcgccgtccgtgcccttgtagatggcctgctcaaacgcgtccaggcccttgagggtaccaaacgtcgcgtccatcccgatgatggcaatcggtccaggagtcacctcgggaagcaccggcgaggctgtcgcagtagcagcaatttggcggtgctcacggaagacacagtgcgcgttggttccaccaaagccaaaggcggagagcgaggcgcacttgagctcatcgcctggtttgcctgcccgcgcctgcgccgacgagtacggccaagggatggcctcgtccacgacgagcgggtcgatgcagttggagcggtcgacaccgggcgtgggcgggatcgtgccgtgctgcatcgacagcagcaccttggccatgcctgcgaacccggccgccacgagagtgtggccaaagttgcccttggtggagcccatgcgcggcgggtggtccgtgttacctcgaaagcagtggcgcagcgcctctacctccacgacgtcgccctgcggagtgcccgtggcgtggcactccacgtactgcacctcgcttgggtcgatgccgacgctcgtgtacaggtcctccatgcacgacttctcgctcggcaggtgcgggctcagcggcaggccgcacccggcgttgctcagactcgtgccgagcaaggtgccgtagatgcggtcgccgtcgcgcacggcgtcctcgaggcgcttcagcaccatgatggcgccgccctctccgggcgtcaggccctggctgccctgccgcagcggcacggacagtgggttatcgtccggtccgcccagcggcatcgcctggaaggtggagaaccccgagagaatgaagaacgggtccggaaagcatgtggcgccgcacagcatcacgtccgcgctgcgcgagagcaagtggtcggacgccagcttgaggcagtacagcgccgacgcgcaggctgcatcgaggctgtagcgcacgggccccaggccgagctggttggccacgaaggacgccgggtcggagtacacgcgcgggtcgctggcctcgggcgagacagcgcgcgggcgctccgaccaggggcgcgagtcgcggaagcgctgggcgcccacgcggttctccacatgcacttggtacagattgagcagctcgccctgcagattgtccatggggaacgacaggcagccgctcacgatgccgaagtcgcgtaggttggcggtggtgctggcgtcgtcgaggttaattccggcgtcgagcagggcgcgccgggccaggtcggcgaggaggtcgtgctcgttgtcgacgctggcatcgacgcagccgtagcgatcgttgcagaaggtgtcggcgtacttgctgcgctgcgggtggaagtggaggtcgcggtagcgcgtaccgaggcgctccgccgagatcgggctcgagttgatctccttacgcatcagcgtatcccagaactcgtcctggttcttgcatccggcatactgcaccgccatgcccacgaccgcaatgttatcgcacggcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaggtctagatcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 24 - DNA, 36553 bp, Artificial Sequence
  Plasmid pDAB109591
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgacacaactttgtatacaaaagttgtctagacctaggctcagcaactcatccagtcaagttcgagtcagtgagttgggcggccgcgaattcggcgcgccaaccttggactcccatgttggcaaaggcaaccaaacaaacaatgaatgatccgctcctgcatatggggcggtttgagtatttcaactgccatttgggctgaattgaagacatgctcctgtcagaaattccgtgatcttactcaatattcagtaatctcggccaatatcctaaatgtgcgtggctttatctgtctttgtattgtttcatcaattcatgtaacgtttgcttttcttatgaattttcaaataaattatcgatagtactacgaatatttcgtatcgctgatcttctcaatcacaatgatgcgtagtgacccgacaaataatttaagcgtccttaataccaatcctaaaataattgaggcaaataaaatttttttgtaatttttatgatagcagatcgattctccagcaagcctgcaacaaaatattgtgtatttctaaatagattttgatactcgaggtgaccgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcatcgaagaagatcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctagtagcacatctgtactcactcaggtctagtggtcaggtcagattaattaagcggccgcgaattcggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcaaacaatgatgtactcaacgtcatcgtcttgctgttgctgttgaacccttctgtaatgagaggctcccagcaagatgtgctggttgatgtccacaactctcgggaactcaccagtcccagccgtggcatcaagtttggtgcctctgacgaagtcattgaagctgcctattgcaggaccacaccaaatctgatagtccgctttccttgctgaagtggcctctgttgcccaacgtgagctttgagacatgtaccatctgacacagagagccatcctctcttgcggacttgcagccgtggcatcaaccccaaacttttcccttgcagctgcccaaacatcagcaacactctgcttgaacactgatctctccagttttctcagttgcggttctggcacagcatcaaaggaaccaaacttggcttggagctgagccaacatcgttgctctcgcagcgaacatggtttgtttcttcaacacttggactccaccaggagccatcgccacatcactataggtggcagtcgccaaaaggagtctgactgcatcagaggtcccagcttcacgagcaagctggttgacacttccagtgaccacaaaggctgcacccaaggagaaggcaagcaacgctgctctcggacatgctatcccacctccagctcccacacgcactggcgtgtcaaccagatgcctccatctgttcctctgagccacaaccaaaggaaggagcacatggattggacggttgtcagtgtgccctccagaatctgcctccaccgcgacatcgtcagccatcgcgactctgctggcaagcgcagcttgctcaggagtgatttgtttggctgccaccaaagcctcaagaacagctgcaggtgctggtctcaggaaatgttcagccacctcagttcttgaaactttggccacaacacggtgagtcgctgacacagaagcaccacaggaggtccttctgagaccggtcacacggtatctcaccagatccgcagagagcgcacccgtgtaaccagacgcctccacaatgctgactcccgttctcagaagggcatccaccgttgcagcttcatcaggaccaggcatgaggttgacagcaaaggcattggaggttctctgttggatctcacggatctggagttcaacttgatccatcggaagcctcgctgctccaaatgatgcaagcatcctagcttctgcagctgcaaccacaaggtcaacagaggagattccttcagccatcgctcccatgtagagaggccaatccacatcatagcatctgaggaaggcatcgtctccaacaagcaaagatgaggaagtctgcttggctttgacaaccggtgttgaatcagcaaccacagctccggcagctgcaaccacaacagctttggctggatggagacgaaccatgcaatgtgtgctgggtttggcacttgcagctgcaacttgtttgcttatgccatcagggcagaagtaaccattgacttcaacagacctcaggaatctgttgggcttgggaggtggttcttgcattgcagaatctatggctgtgaggaaggttgggtggtaaagatccgcaaagagagtcgggttgtgaagaggcactctgtgggcagtgagcagggcaagagatttgagtgtctgtgtccaagctgactcacttggacgatcaagagccacactgacatgaggagttgcagccttcccaagaatgtcactgacagctgctgacctcatgttattcggaccaacttccacgaaaacatcatggccatcacggctgaccttgtcaacaatgccagggaaatccgctattctggtgtacaacttctgaacgaactctgtgatggaagagttgctgcctcctctcagctcagcattggtgactgaggtatacatcttgacagggctgtcaggaatctccaagatttcgtggatgtgagctattccaggagtatagggagccacttctgggcagtgcccaatcatgccttgcttgactggcatgggtggcaaacgacctccaagacgctcaagcaccctcagacactcagcaggtttgccagcaatgagggcactgctggagtcgttgacaatgagcaaacgaacaaatctgttgtccggtccaatggccttttcaatctctgctctgctggcacgaaccaagtagccttgccagaaggactcaactggagcatcagcagggacattccaaagtttcctcaaggcttggaactccacagcaagctgtgtgctccagaccggagaggttctgagcctctgagtgagctggtcagaaagtccacagtttctccttgaaagtgcaaagagcatggagatttctccaagggagagtccaaagcaagccttgggttggactccaaggacatcacgagcatagtctgtgaggcaaatggaaacaaagattcccgtcctaaacatctctatctggtcagcatcaaaagccgtctggacagccctctgagagtcagcatcaaccgctctgggcatgagccaggagtctccattctcccaaagtgcagctgtcttgtcattgatcctctcatgcaaagcaggccagagtctgtgaaggtccaacccaacaccatagtagggagacctcccttcaccatacatgaacgcaacacgatcactggtgacaggtgttggtgcaaaagcagaaccagatggtgacatccagtttctgccagccttggctgatcttggaacacccttggctgccaactccaattctttctccagcttttctggagttgtgagcagagccaaacacaaggtcgctgtggcaccgtgactggcaactgtttcaccaacaagcctcaagaacctcaaacgatgagcagtgaaagcaacagctgcagctgggtcatcgtcagtggcagacccagtttctgcatgagcacggagcaacgcaagttcagcattgacttttgccatgatgtcatcaacagtgtctccacgaatcgctatgagtttgggtgcagcgtcatccaatgacaatctgttgctggactcatgtgtggcatactcatctgtgagaagcactccaaagcaagacccactctcagaagcactggccactgcagcaagtctggactcaccagggttcttgagccaagcacgggaccttggacaggtgaaaagagcctctgagactggagccacaggtctttcccactgtgggtttgcaggcaagtaacggttgtggaggcaaagcgcagtctttatgagagaagctgcaccactcgcatatccaacatctccaacattggcacgaacacttccaatcgcgactgaaccagggacttgatgagccaagagtttagacacttgctcaagctgtgattcagcactcaaaggagagttggccaagtggggagcatgacgaccagagtcagctgcgagttccaccatctccacaacccttttctcattgtcatcattgtgaacttgaaggagaagaggagaaactgcttcagcaggctgcgctgcacatgtgaggccagcaacactggcatagaccttgtcatctgagccaacatcagcttgcctcttcaagaccagagcaccactgccctctccagcaaagtatccatcagcagaagcctcaaagttggcacgtggatggtcttgtctgcttatggcagaccttcttgccttgaggtaaaggttctcagcagttgcacagagatcaactccagcaaccacaactgcatccacttggtgggtgtccaaaaggaactttcccagctcaaggcaacgatagactgagtttgcaccttcagtgaccgtgaaagaaggaccagtgaatccccactgtgaggaaactctggtggccacaagattcccaatgtaagaagtgtagctggttgaggttccacaatcattgatgtaatccatcatttcttgaacttgttcaggggagaaagctgctgggtcaagcctttccttgagtgtcacccttgcacggtgtctgtaaagctcagtgtcagtgcccaaccccaccaggacagcaacttttccacccgtggccatgccagcatcttgaagtgccctatccatcgtggcaactgccagaagctgttggggtctgaggacatcttcagggatcatgggacttctgagtcttttgtagtccacatcaacatccctcacatagcaccctctcgggactgcatccagacccattgcagtcaagaaatctgtgtcagcaccaaggaacctccatctcttggatggcagatcagatgctccatccgtgcctttgtagatcgcttgttcaaacgcatcaagtcctttgagggtgccaaacgtcgcatccatcccaatgattgcaatgggtccaggggtgacttcaggaaggaccggagacgctgtcgcagtggcagcaatctgtctgtgttctctgaacacacaatgagcatttgttccaccaaatccaaaggctgagagggaagcacacttcaattcatctccaggtttgccagctctcgcttgagctgagctgtaaggccagggtatggcctcatcaacgaccagcggatctatgcagttgctcctatcaacaccaggcgtgggtgggatcgtgccatgctgcatggaaagcaacactttggccattccagcaaacccagctgcaaccaaggtgtgaccaaagtttcctttggtggaacccatcctcggtgggtggtcagtgttgcctctgaagcaatgtctcagagcctcaacttcaaccacatctccttgcggagttccggtggcatgacactcgacatactgaacctcagatggatctatgccaactgacgtgtacaaatcctccatgcagcttttctcagacggcaggtgaggtgaaagtggcaaaccacaaccagcattgctgagacttgtcccaagcaaggtgccatagatcctatcaccatccctcacagcatcttccaaacgcttcagaaccatgatggctccaccttctccaggtgtgagtccttggctgccttgacggagtggcacagagagtgggttgtcatctggtccacccaatggcatcgcttggaatgtggagaacccagagagaatgaaaaacgggtctgggaagcatgtggcaccacacagcatgacatctgcagaacgggagagcaagtgatcagaagccaacttgaggcagtacagcgcactcgcacaagctgcatcaaggctgtatctgacaggaccaagaccaagctggttggccacaaaggaagcagggtcgctgtagaccctcgggtcactggcttcaggggacacagctcttggtctttctgaccagggtcttgaatctctgaacctctgggcacccacacggttctcaacgtggacttgatagagattcaaaagctcaccttgcagattgtccatcgggaaggagaggcatccactcacaatcccaaagtcacgaaggttggcagtggtgctggcgtcatccaagttgatcccagcatcaagcaaagcacgtctggcaaggtcagcaagcaagtcatgctcattgtcaacagaagcatcaacacaaccatatctgtcattgcagaaggtgtctgcatacttgctcctctgaggatggaagtggaggtctctgtatcttgtcccaagcctctccgctgagatcggtgagctgttgatctccttcctcatcagtgtgtcccagaactcgtcctggttcttgcatccagcatactgaactgccattccaaccacagcaatgttgtcacacggcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaactactgtcactgaggccgtagacgagtacggactgatctaactagtgctagcctcgaggtcgacacccagcttt

SEQ ID NO: 25 - DNA, 36658 bp, Artificial Sequence
  Plasmid pDAB109592
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgacacaactttgtatacaaaagttgtctaggtcgacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggctagcactagtttaattaagcggccgctttgatcgaggaggaagatctaaacttggagaatgtctactattcagagatgaaagatgctggattctttgacgctgattgggaataaatcataacctgtatatacaatgtgataggattgtttataaatgaagctagtgtcatcttagggactactctttcacttatgtatctgttaatacaactctttcattttggattttagaaaaagaaaaagctttcatgtgtaacccaaaagttttcagtcgacaaatagagagagagatccatggcatacagattactaccaaagagtcgcttgacttgacatcataataaaagaaaatgacagaaagattatgaaaacaacaaagcctttggttcttctcttaatactaaaagggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcccacgagagagatctgctccaacgagagagagagatggcggagtgtacaaagagcgtgatgtcccgaggtagctcgttttcatttataagcttggtgcactctaaacgacgccgttacgtaataagatgggcctctctaggcctgttaagtcttaaattagcccatcattactaatgttcgtgtgaaggtaaacatatcacgtgccagattaacataattgaactgaaatgaaccatgtcaaaccggtcttaaccgagacataccagccgaattaaaatttatgggggccatagtgactgaatagtcaaaacatataaaccaaacagtacccatatcttaccaatcagatctgcggccgccctaggtctagatcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcatcgaagaagatcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctagtagcacatctgtactcactcaggtctagtggtcaggtcagattaattaagcggccgcgaattcggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcaaacaatgatgtactcaacgtcatcgtcttgctgttgctgttgaacccttctgtaatgagaggctcccagcaagatgtgctggttgatgtccacaactctcgggaactcaccagtcccagccgtggcatcaagtttggtgcctctgacgaagtcattgaagctgcctattgcaggaccacaccaaatctgatagtccgctttccttgctgaagtggcctctgttgcccaacgtgagctttgagacatgtaccatctgacacagagagccatcctctcttgcggacttgcagccgtggcatcaaccccaaacttttcccttgcagctgcccaaacatcagcaacactctgcttgaacactgatctctccagttttctcagttgcggttctggcacagcatcaaaggaaccaaacttggcttggagctgagccaacatcgttgctctcgcagcgaacatggtttgtttcttcaacacttggactccaccaggagccatcgccacatcactataggtggcagtcgccaaaaggagtctgactgcatcagaggtcccagcttcacgagcaagctggttgacacttccagtgaccacaaaggctgcacccaaggagaaggcaagcaacgctgctctcggacatgctatcccacctccagctcccacacgcactggcgtgtcaaccagatgcctccatctgttcctctgagccacaaccaaaggaaggagcacatggattggacggttgtcagtgtgccctccagaatctgcctccaccgcgacatcgtcagccatcgcgactctgctggcaagcgcagcttgctcaggagtgatttgtttggctgccaccaaagcctcaagaacagctgcaggtgctggtctcaggaaatgttcagccacctcagttcttgaaactttggccacaacacggtgagtcgctgacacagaagcaccacaggaggtccttctgagaccggtcacacggtatctcaccagatccgcagagagcgcacccgtgtaaccagacgcctccacaatgctgactcccgttctcagaagggcatccaccgttgcagcttcatcaggaccaggcatgaggttgacagcaaaggcattggaggttctctgttggatctcacggatctggagttcaacttgatccatcggaagcctcgctgctccaaatgatgcaagcatcctagcttctgcagctgcaaccacaaggtcaacagaggagattccttcagccatcgctcccatgtagagaggccaatccacatcatagcatctgaggaaggcatcgtctccaacaagcaaagatgaggaagtctgcttggctttgacaaccggtgttgaatcagcaaccacagctccggcagctgcaaccacaacagctttggctggatggagacgaaccatgcaatgtgtgctgggtttggcacttgcagctgcaacttgtttgcttatgccatcagggcagaagtaaccattgacttcaacagacctcaggaatctgttgggcttgggaggtggttcttgcattgcagaatctatggctgtgaggaaggttgggtggtaaagatccgcaaagagagtcgggttgtgaagaggcactctgtgggcagtgagcagggcaagagatttgagtgtctgtgtccaagctgactcacttggacgatcaagagccacactgacatgaggagttgcagccttcccaagaatgtcactgacagctgctgacctcatgttattcggaccaacttccacgaaaacatcatggccatcacggctgaccttgtcaacaatgccagggaaatccgctattctggtgtacaacttctgaacgaactctgtgatggaagagttgctgcctcctctcagctcagcattggtgactgaggtatacatcttgacagggctgtcaggaatctccaagatttcgtggatgtgagctattccaggagtatagggagccacttctgggcagtgcccaatcatgccttgcttgactggcatgggtggcaaacgacctccaagacgctcaagcaccctcagacactcagcaggtttgccagcaatgagggcactgctggagtcgttgacaatgagcaaacgaacaaatctgttgtccggtccaatggccttttcaatctctgctctgctggcacgaaccaagtagccttgccagaaggactcaactggagcatcagcagggacattccaaagtttcctcaaggcttggaactccacagcaagctgtgtgctccagaccggagaggttctgagcctctgagtgagctggtcagaaagtccacagtttctccttgaaagtgcaaagagcatggagatttctccaagggagagtccaaagcaagccttgggttggactccaaggacatcacgagcatagtctgtgaggcaaatggaaacaaagattcccgtcctaaacatctctatctggtcagcatcaaaagccgtctggacagccctctgagagtcagcatcaaccgctctgggcatgagccaggagtctccattctcccaaagtgcagctgtcttgtcattgatcctctcatgcaaagcaggccagagtctgtgaaggtccaacccaacaccatagtagggagacctcccttcaccatacatgaacgcaacacgatcactggtgacaggtgttggtgcaaaagcagaaccagatggtgacatccagtttctgccagccttggctgatcttggaacacccttggctgccaactccaattctttctccagcttttctggagttgtgagcagagccaaacacaaggtcgctgtggcaccgtgactggcaactgtttcaccaacaagcctcaagaacctcaaacgatgagcagtgaaagcaacagctgcagctgggtcatcgtcagtggcagacccagtttctgcatgagcacggagcaacgcaagttcagcattgacttttgccatgatgtcatcaacagtgtctccacgaatcgctatgagtttgggtgcagcgtcatccaatgacaatctgttgctggactcatgtgtggcatactcatctgtgagaagcactccaaagcaagacccactctcagaagcactggccactgcagcaagtctggactcaccagggttcttgagccaagcacgggaccttggacaggtgaaaagagcctctgagactggagccacaggtctttcccactgtgggtttgcaggcaagtaacggttgtggaggcaaagcgcagtctttatgagagaagctgcaccactcgcatatccaacatctccaacattggcacgaacacttccaatcgcgactgaaccagggacttgatgagccaagagtttagacacttgctcaagctgtgattcagcactcaaaggagagttggccaagtggggagcatgacgaccagagtcagctgcgagttccaccatctccacaacccttttctcattgtcatcattgtgaacttgaaggagaagaggagaaactgcttcagcaggctgcgctgcacatgtgaggccagcaacactggcatagaccttgtcatctgagccaacatcagcttgcctcttcaagaccagagcaccactgccctctccagcaaagtatccatcagcagaagcctcaaagttggcacgtggatggtcttgtctgcttatggcagaccttcttgccttgaggtaaaggttctcagcagttgcacagagatcaactccagcaaccacaactgcatccacttggtgggtgtccaaaaggaactttcccagctcaaggcaacgatagactgagtttgcaccttcagtgaccgtgaaagaaggaccagtgaatccccactgtgaggaaactctggtggccacaagattcccaatgtaagaagtgtagctggttgaggttccacaatcattgatgtaatccatcatttcttgaacttgttcaggggagaaagctgctgggtcaagcctttccttgagtgtcacccttgcacggtgtctgtaaagctcagtgtcagtgcccaaccccaccaggacagcaacttttccacccgtggccatgccagcatcttgaagtgccctatccatcgtggcaactgccagaagctgttggggtctgaggacatcttcagggatcatgggacttctgagtcttttgtagtccacatcaacatccctcacatagcaccctctcgggactgcatccagacccattgcagtcaagaaatctgtgtcagcaccaaggaacctccatctcttggatggcagatcagatgctccatccgtgcctttgtagatcgcttgttcaaacgcatcaagtcctttgagggtgccaaacgtcgcatccatcccaatgattgcaatgggtccaggggtgacttcaggaaggaccggagacgctgtcgcagtggcagcaatctgtctgtgttctctgaacacacaatgagcatttgttccaccaaatccaaaggctgagagggaagcacacttcaattcatctccaggtttgccagctctcgcttgagctgagctgtaaggccagggtatggcctcatcaacgaccagcggatctatgcagttgctcctatcaacaccaggcgtgggtgggatcgtgccatgctgcatggaaagcaacactttggccattccagcaaacccagctgcaaccaaggtgtgaccaaagtttcctttggtggaacccatcctcggtgggtggtcagtgttgcctctgaagcaatgtctcagagcctcaacttcaaccacatctccttgcggagttccggtggcatgacactcgacatactgaacctcagatggatctatgccaactgacgtgtacaaatcctccatgcagcttttctcagacggcaggtgaggtgaaagtggcaaaccacaaccagcattgctgagacttgtcccaagcaaggtgccatagatcctatcaccatccctcacagcatcttccaaacgcttcagaaccatgatggctccaccttctccaggtgtgagtccttggctgccttgacggagtggcacagagagtgggttgtcatctggtccacccaatggcatcgcttggaatgtggagaacccagagagaatgaaaaacgggtctgggaagcatgtggcaccacacagcatgacatctgcagaacgggagagcaagtgatcagaagccaacttgaggcagtacagcgcactcgcacaagctgcatcaaggctgtatctgacaggaccaagaccaagctggttggccacaaaggaagcagggtcgctgtagaccctcgggtcactggcttcaggggacacagctcttggtctttctgaccagggtcttgaatctctgaacctctgggcacccacacggttctcaacgtggacttgatagagattcaaaagctcaccttgcagattgtccatcgggaaggagaggcatccactcacaatcccaaagtcacgaaggttggcagtggtgctggcgtcatccaagttgatcccagcatcaagcaaagcacgtctggcaaggtcagcaagcaagtcatgctcattgtcaacagaagcatcaacacaaccatatctgtcattgcagaaggtgtctgcatacttgctcctctgaggatggaagtggaggtctctgtatcttgtcccaagcctctccgctgagatcggtgagctgttgatctccttcctcatcagtgtgtcccagaactcgtcctggttcttgcatccagcatactgaactgccattccaaccacagcaatgttgtcacacggcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaactactgtcactgaggccgtagacgagtacggactgatctaactagtgctagcctcgaggtcgacacccagcttt

SEQ ID NO: 26 - DNA, 36494 bp, Artificial Sequence
  Plasmid pDAB108960
gtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggatactcgcatcgcgatcgtggggatgtcggcgatcctgccgagcggggagaacgtgcgcgagagctgggaggcgatccgcgatgggctggattgcctgagcgatctgccggcggaccgcgtggacgtgacggcctactacaacccggagaagacgaccaaggacaagatctactgcaagcgcggcgggttcatcccggagtacgacttcgacgcgcgtgagttcgggctcaacatgttccagatggaggactcggacgccaaccagacgatctcgctgctcaaggtgaaggaggcgctgacggacgccaacatcccggcgttctcgagcggtaagaagaacatcggctgcgtgctgggcatcggcggcggccagaaggcgagccacgagttctactcgcggctcaactacgtggtcgtggacaaggtgctgcgcaagatgggcctgccggaggaagacgtggcggcggcggtggacaagtacaaggcgagtttccccgagtggcgcctcgactctttccccgggttcctgggcaacgtcacggcggggcgctgctgcaataccttcaacatggagggcatgaactgcgtcgtggacgcggcctgcgcgtcgtcgctgatcgcggtcaaagtggcgatcgaggagctgctctacggcgactgcgatgcgatgatcgcgggtgccacctgcacggacaactcgatcgggatgtacatggccttctccaagacgcccgtgttttccacggacccgagcgtcaaggcgtacgacgccgccaccaaaggcatgctcatcggcgagggctcggcgatgctcgtgctgaagcgctacgcggacgccgtgcgcgacggcgacaccgtgcacgccgtcatcaaggggtgcgcgtcctcgagcgacggcaaggcggcgggcatctacacgccgacaatctcgggccaggaggaggccctgcgccgcgcctacgcccgcgccaatgtcgacccggccactgtgacgctggtggagggccacggcacgggtacgccggtgggcgacaagatcgagctgacggcgctgagcaacctcttctccaaggcgttttctgccaacggtggcggcgcggaggaagcagagcaggtggcggtgggcagcatcaagtcgcagatcgggcacctcaaggcggtggccgggctggccgggctggtcaaggtggtgctggcgctcaagcacaagacgctgccgcagacgatcaacgtcgacaagccgccgtcgctggtggacgggaccccgatccagcagtcgccgctgtacgtcaacacgatgaaccgcccctggttcacgcccgtaggggtgccgcgccgcgccggcgtgtcgtcgtttgggtttggcggtgccaactaccacgccgtgctggaggagtttgagcccgagcacgagagcgcgtaccggtacaacaacctgccgcaggtggcgctgctgcacgcgggggacgtcgcgaccttggcggcgacggttcgcgccaagctggcgctggccaccgccgagcaggaagaggcgcgtgtggtgaagaacgcggactacatcgcgtaccaccggttcctggacgagtgcaagttgcgcggcgctgtgccgcaggcgcacgcgcgggtgggactgctcgtacgggacctgagctcgctcatcgccgtgctcgaggccgctgccgccaagctcgcgggcgaagagagcgcgacggagtggacggtcagcgttgctacgggcgaggcggccttccgcgtgcgcggtgtggctacggaggccaacgtggcggcgctgttctcgggccagggcgcgcagtacacgcacatgttcagcgacgtggcgatgaactggcccccgttccgcgagagcgtcgccgccatggaccgcgcccagcgcgagcgcttcgggcggcctgccaagcgcgtgagcagcgtgctgtacccgcgcaagccgtacggcgacgaaccgcggcaggaccacaaggagatctcgcaaacgcgctactcgcagcccgcaacgctcgcgtgctcggtcggcgcctttgacatcttcaaagcggcgggactggcgccgagctttgcggcgggccactcgctgggcgagtttgcggcgctctacgcggccgggtcgctcgatcgcgacgccgtcttcgacctggtctgcgcgcgcgccaaggccatgagcgacttcacggcccaggccagcagcagcggtggcgccatggcggccgtgattggcgccaaggcggaccagctctcgctgggtggcgcgcccgacgtgtggctcgccaacagcaactcgccctcgcagaccgtgatcacgggaaccgccgaagcagtggctgcggcctctgacaagttgcgctgcagcggcaacttccgcgtcgtgcctctggcctgcgaggcggccttccactcgccgcacatgcgcggcgcggagcagacgtttgcgtcggcgctcgcgcaggcgcccgtgtcggcaccggcggctgctcggttctactctaacgtgacggggggcgccgcggtaacctcgcccgcggacgtcaaaacgaacctgggcaagcacatgacgagccctgtgcagttcgtgcagcaggtgcgagccatgcacgcggcgggcgcgcgtgtgtttgtggagtttgggcccaagcaggtcctgtcgcgcctcgtcaaggagacccttggcgaggccggcgacgtggtcacggtcgccgtcaacccagactcggccaaggacagcgacacgcagctgcgccaggcggcgctcacgttggcggtcgccggcgtgccgctcaaggactttgaccgctggcagctgccggatgccacgcgcctcgagcctgtcaagaagaagaagaccacgttgcggctctcggcagccacctacgtctccgccaagacgttgcgccagcgcgaggccgtgctcaacgacggctacactgtcagtggtgccacggcggtagtcaaggaagtggacacggccaacgaggagcgtctcgtccgccaagcccaggatctccagcgccagctcgcggaggcctcgacggcagcccaggcggcgcagtccaaggtcgcggagctcgagcgcacgatccaggacttggagcgcaaggtgcagcagcagcagcaagagaagggtgagaactcagacagcaacgctgccgccgaagtgctgcggcgccacaaggagctgctccagcgcatgctgcaggactgtgacgagcaggcagtgcccgtagccacggtggttccgacacctacgtcctccccgacgcctacatcctcacccgtatccggcaacagcaagagcactcgtggcagtgctgatctgcaagcgctgctggccaaggcggagactgtggtgatggctgtgctggctgccaagactggctacgaggccgacatggttgaggcggacatggacctggaggccgagctcggcatcgactcgatcaagcgcgtggagatcctttccgaggtgcagggccagctgggcgtcgaggccaaggacgtggatgcgctgagccgcacgcgcacggtcggtgaggttgtggacgccatgaaggcggagatcgtggctgcctctggtggtagtgctcctgcggttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctgctggtagtgctcctgctcctgctgttccttcggcgcccgctgcttctgcagctccgactcccgctgcttcgactgcgccttctgctgatctgcaagcgctgctgtccaaggcggagacggtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctcctgcggttccttcggcgcccgctgcttctgcagctccgactcccgcggctgcgacagcgccttctgctgatctgcaagcgctgctggccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaggttgtggatgccatgaaggcggagatcgtggctgcctctgctggtagtgctcctgctcctgctgttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctgctgctgttccttcggcgcccgctgcttctgcagctccgactcctgcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaagtggtggacgccatgaaggcggagatcgtggctgcctctggtggtagtgctcctgctgctccttcggcgcccgcgcttcttccaacgctgtttggttccgagtgcgaggacctgtctctgacctttcccgtgataacgaccctgccgcttcctgcagagcttgtgctggccgagggcggcgctcgccctgtagtcgtggtggatgatggatctgcactcacctcgtcgctggtgtcctcgctcggcgatcgtgcggtgctgctgcaggtgcagtcttcctctgcctgctcgccgcgctcgaccacgcacaagttggtgaccgtagcagaccgctctgaagcggcgctacaggcggcgctcacgtccgtcgaggcgcagttcggcaaggtgggtggctttgtgttccagttcggcgacgacgacgtgcaagcgcagctcggctgggcgctgctcgcggccaagcacctcaaaacttcgctgtcagaacagatcgagggcggtcgcacctttttcgtggccgtcgcgcggctcgacggccagctggggctctccggcaagtcgacgaccgctaccgttgatctctcccgcgcgcagcagggcagcgtgttcggcctgtgcaagacactcgacctggagtggcccgctgtcttctgccgcggaatcgacctggccgccgacctcgacgccgcacaggccgcgcggtgcctgctgggcgagctgtcagaccccgacgtggccgtgcgcgagtctggttactccgcctcgggccagcgctgcacgacaactacgaagtcgctgactacgggcaagccgcaccagccgatctcctcgtcggacctctttctggtgtcgggcggcgcgcgcggcatcaccccgctgtgcgtgcgcgagctggcgcagcgcgtgggcggcggcacgtacgtgctcatcggccgctcggagctgcccacgacggagcctgcctgggcggtcggcgtggagtctggcaagccgctggagaaggccgcgctggcgttcctgaaggcggagtttgcagcgggccgcggggccaagccgacgccgatgctgcacaagaagctcgtgggcgccgtggtcggagcgcgcgaggtgcgagcctcgctcgccgagatcactgcacagggcgccacggctgtgtacgagtcgtgcgacgtgagctctgccgccaaggtgcgtgagatggtagagcgcgtgcagcagcagggcgggcggcgcgtgtcgggcgtgttccacgcgtcgggcgtgctgcgcgacaagctcgtggagaacaagtcgctggcggacttcagcgccgtgtacgacaccaaggtgggcggcctcatcaacctgctggcctgcgtggacctggcgcagctgcgtcacctcgtgctcttcagctcgctcgcgggcttccacggcaacgtcgggcagtcggactacgcaatggccaacgaggcgctcaacaagctggcggcgcacctgtcggcggtgcacccgcagctgtgcgcgcgctcgatctgcttcggaccgtgggacggcggcatggtgacccccgcgctcaaggccaacttcatccgcatgggcatccagatcatcccgcgccaaggcggcgcgcagaccgtcgccaacatgctcgtcagtagctcccccggtcagctgctcgtgggcaactggggcgtgccacccgtcgtgccgagtgccaccgagcacaccgtgctgcagacgctccgccagagcgacaaccccttcctcgactcgcacgtgatccagggccgccgcgtgctgcccatgaccctggccgtgggctacatggcgcaccaggcgcagagcatctacgcgggccaccagctgtgggccgtcgaggacgcccagctcttcaagggcatcgccatcgacaatggcgccgacgtgcccgtgcgcgtggagctgtcgcgccgcaaggaggagcaggaggacgccggcaaggtcaaggtcaaggtgcaggtgctgctcaaatcgcaggtcaacggcaagtcggtgcccgcgtacaaggcgaccgtcgtgctgtcccctgcgccgcgccccagcgtcatcacgcgtgacttcgacctcaccccggacccggcctgcacggagcacgacctctacgacggcaagacgctcttccacggcaaggccttccagggcatcgagcaggtgctctcggcgacgcccaagcagctcaccgccaagtgccgcaatttgcccctcacgcccgagcagcgcggccagttcgtcgttaacctcagccagcaggacccgttccaggcggacattgcgttccaggcgatgctcgtctgggcgcgcatgctgcgccaatcggcggccctgcccaacaactgcgagcgcttcgacttttacaagccgatggccccgggcgccacctactacacgtcggtcaagctggcctcggcctcacccttggtggactctgtgtgcaagtgcaccgtggcgatgcacgatgagcaaggtgaggtgtacttttctgctcgtgccagcgtcgtcctcaacaagaccctcacgtactaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcgaattcggcgcgccaaccttggactcccatgttggcaaaggcaaccaaacaaacaatgaatgatccgctcctgcatatggggcggtttgagtatttcaactgccatttgggctgaattgaagacatgctcctgtcagaaattccgtgatcttactcaatattcagtaatctcggccaatatcctaaatgtgcgtggctttatctgtctttgtattgtttcatcaattcatgtaacgtttgcttttcttatgaattttcaaataaattatcgatagtactacgaatatttcgtatcgctgatcttctcaatcacaatgatgcgtagtgacccgacaaataatttaagcgtccttaataccaatcctaaaataattgaggcaaataaaatttttttgtaatttttatgatagcagatcgattctccagcaagcctgcaacaaaatattgtgtatttctaaatagattttgatactcgaggtgaccgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcatcgaagaagatcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctaggtcgatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtcgacctcgaggctagcactagttagatcagtccgtactcgtctacggcctcagtgacagtagttaattaagcggccgcgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactacttatacgatgatgtattctacgtcgtcgtcctgttgttgttgctgcacgcggcggtagtgcgaggctccgaggaggatgtgctggttgatgtccacgacgcgcggaaactcgccggtgccagcggtcgcgtccagcttggtgccgcgaacgaagtcgttgaagctgccgatggcggggccgcaccagatctggtagtccgccttgcgcgcggacgtcgcctcggtagcccatcgcgacgactgcgacatgtaccagcgcacacagagcgccatcctctcctgcggacttgcagcggtagcgtcgacaccaaacttttcgcgtgcagcagcccacacgtccgccacggactgcttgaacacggagcgctcgagcttgcgcagctgcggctccggcacggcgtcaaaggagccgaacttggcctgcagctgggcgagcatcgtggcccgcgcggcgaacatggtctgcttcttgagcacctggacgccgcccggcgccatggccacgtccgagtaggtggccgtcgccagcagtagtcggaccgcgtcgctggtgccagcctcgcgggccagttggttgacggacccggtgaccacaaaggcggcgcccagggaaaaggcgagcagcgcggcgcgcggacaggcgatcccgccgccggcgccgacgcgcactggcgtgtccaccaggtggcgccagcggttgcgctgcgccaccacgagcggcagcagcacgtggatcggtcggttgtcggtgtgcccgcccgagtcggcctccaccgcgacgtcgtcggccatggcgacgcggctggccagcgcggcctgctcgggcgtaatctgtttggcggcgaccaaagcctctagtacggcggccggcgccgggcgcagaaagtgctcggccacctcggtgcgcgacaccttggcgaccacacggtgagtcgccgacacagaagcaccgcaactagttcgtcgcagacccgtgacacggtagcgcaccaggtctgcagagagcgcgccggtgtagcccgatgcctcgacgattgagacgcccgtgcgcagcagcgcgtccaccgtcgcggcctcgtcaggacccggcatcaggttgacagcaaaggcgttggaggtgcgttgctggatctcacggatctggagttccacctggtccataggcaagcgggccgctccgaatgatgccagcatgcgggcctcggcggcagcgaccaccaggtctaccgacgagatgccttccgccatggcgcccatgtagagcggccagtccacgtcgtagcagcgcagaaaggcgtcatccccaaccaacaacgacgacgacgtctgcttggccttgaccacgggcgtcgaatcagcaaccacagcaccagcagcagcaaccacaactgccttggctgggtgcaaacgaaccatgcaatgcgtcgagggtttggcacttgcagcagcaacctgcttgctgatgccgtcggggcaaaagtacccgttgacctctacgctgcgaaggaagcggttgggcttgggcgggggctcctgcatcgcagagtcgatagccgtcaggaacgtggggtggtacaggtccgcaaacagagtcgggttgtgcaggggcacgcggtgggcggtcagcagcgccagcgacttgagggtctgcgtccacgccgactcactggggcggtccagcgccacggagacatgcggggtggcagccttgccaagaatgtcactgaccgcggcggagcgcatgttgttcggccccacctcgacgaagacatcgtggccgtcacggctgaccttgtcgacgatgcccggaaagtcggcgatgcgcgtgtacaacttctgcacgaactcggtgatgctgctgttgctgcccccgcgcagctcggcgttggtgaccgaggtgtacatcttgacggggctgtccggaatctccaaaatctcgtggatgtgcgcgatgcccggcgtgtagggcgccacttcggggcagtgcccaatcatgccttgcttgacgggcatcggcggcaaccgcccgcccaggcgctccagcacgcgcagacactcggcaggtttgccggcgatcagcgcgctgctcgagtcgttgacgatcagcaggcgcacgaagcggttgtcgggcccgatcgccttctcgatttcggcgcggctggcgcgaaccaagtagccctgccagaaggactccacgggggcgtccgccggcacgttccatagcttgcgcaaggcctggaactccaccgccagctgtgtcgaccacaccggcgaggtgcgtaggcgctgcgtgagctggtccgacaggccgcagttgcgtcgcgacagcgcaaagagcatggagatctcgccgaggctgaggccgaagcacgccttgggctgcaccccgagcacgtcgcgcgcgtagtcggtgaggcagatggacacgaagatgcccgtgcggaacatctcgatctggtccgcgtcaaaggccgtctgcacggcgcgctgcgagtcggcatccaccgcgcgcggcatgagccacgagtcgccgttctcccacagcgccgcggtcttgtcgttgatgcgctcgtgcaaagccggccacaggcggtgcaggtcgagcccgacgccgtagtaggggctgcggccctcgccgtacatgaacgcgacgcggtcgctggtcacaggtgtcggcgcaaaggcgctgcccgatggcgacatccagttgcgcccggccttggcgcttcgcggtacacccttggctgccagctccaactccttctccagcttctccggcgttgtcagcagggccaaacacaaggtcgccgtggcaccgtgactagccaccgtctcccctacgagccgcaaaaagcgcaagcgatgagcagtgaaagcgacagcagcagctgggtcgtcgtcagtagcagacccggtttcggcgtgcgctcggaggagcgccagctcggcgttgaccttggccatgatatcgtcaacggtgtcgccacggatcgcgatgagcttgggggcggcgtcatccagcgagaggcggttgctgctctcatgagtggcgtactcgtctgtgaggagcacgccaaagcaggacccgctctcggaggcactggcgacagccgccagtcgcgactcgcccgggttcttcagccaggcacgcgagcgcgggcaagtaaacagcgcctcggagaccggcgccaccggccgctcccactgcgggttggccgggaggtagcggttgtggaggcacagcgccgtcttgatgaggctcgcggcgcccgaggcgtacccgacgtctcccacgttggcgcgcacgctgccgatggccaccgagcccggcacctggtgcgcgagcaacttggacacttgctccagctgcgactcggcgctcagcggcgagttggccaagtgcggcgcatggcgacccgagtcggcggcgagctccaccatctccaccaccctcttctcgttgtcgtcgttgtggacttggagtagtagcggcgacacggcttcagcgggctgcgcggcgcacgtgaggcccgcgacactggcgtagaccttgtcgtctgagccaacgtcggcctggcgcttgaggaccagggcgccgctgccctcgccggcaaagtacccgtcggcgctggcctcaaagttggcgcgagggtggtcctgtcggctgatggcggagcggcgcgccttgaggtaaaggttctcggcggtggcacagaggtcgacgccggccaccacgacggcgtccacctggtgcgtgtcgagcaggaacttgcccagctcgaggcagcggtagaccgagtttgcgccttcggtgacggtgaaggacgggcccgtaaagccccactgcgaggacacgcgcgtggccacgaggttgccgatgtacgacgtgtacgacgtcgaggtgccgcagtcgttgatgtagtccatcatctcctgcacctgctcgggcgagaacgcggccgggtcgagccgctccttgagtgtcacgcgcgcgcggtgccggtacagctcggtgtccgtgccgagccccaccagcaccgccaccttgcctcccgtcgccattccagcgtcctgcagcgcgcggtccatcgtagccaccgccagcagctgttgcgggcgcaggacgtcctcagggatcatcggcgaccgcagccgcttgtagtccacgtccacgtcgcgcacgtagcacccgcgcggcacggcgtcgaggcccatggcggtcaagaagtccgtgtcggcgcccaggaaccgccagcgcttgctcggcaggtcgctggcgccgtccgtgcccttgtagatggcctgctcaaacgcgtccaggcccttgagggtaccaaacgtcgcgtccatcccgatgatggcaatcggtccaggagtcacctcgggaagcaccggcgaggctgtcgcagtagcagcaatttggcggtgctcacggaagacacagtgcgcgttggttccaccaaagccaaaggcggagagcgaggcgcacttgagctcatcgcctggtttgcctgcccgcgcctgcgccgacgagtacggccaagggatggcctcgtccacgacgagcgggtcgatgcagttggagcggtcgacaccgggcgtgggcgggatcgtgccgtgctgcatcgacagcagcaccttggccatgcctgcgaacccggccgccacgagagtgtggccaaagttgcccttggtggagcccatgcgcggcgggtggtccgtgttacctcgaaagcagtggcgcagcgcctctacctccacgacgtcgccctgcggagtgcccgtggcgtggcactccacgtactgcacctcgcttgggtcgatgccgacgctcgtgtacaggtcctccatgcacgacttctcgctcggcaggtgcgggctcagcggcaggccgcacccggcgttgctcagactcgtgccgagcaaggtgccgtagatgcggtcgccgtcgcgcacggcgtcctcgaggcgcttcagcaccatgatggcgccgccctctccgggcgtcaggccctggctgccctgccgcagcggcacggacagtgggttatcgtccggtccgcccagcggcatcgcctggaaggtggagaaccccgagagaatgaagaacgggtccggaaagcatgtggcgccgcacagcatcacgtccgcgctgcgcgagagcaagtggtcggacgccagcttgaggcagtacagcgccgacgcgcaggctgcatcgaggctgtagcgcacgggccccaggccgagctggttggccacgaaggacgccgggtcggagtacacgcgcgggtcgctggcctcgggcgagacagcgcgcgggcgctccgaccaggggcgcgagtcgcggaagcgctgggcgcccacgcggttctccacatgcacttggtacagattgagcagctcgccctgcagattgtccatggggaacgacaggcagccgctcacgatgccgaagtcgcgtaggttggcggtggtgctggcgtcgtcgaggttaattccggcgtcgagcagggcgcgccgggccaggtcggcgaggaggtcgtgctcgttgtcgacgctggcatcgacgcagccgtagcgatcgttgcagaaggtgtcggcgtacttgctgcgctgcgggtggaagtggaggtcgcggtagcgcgtaccgaggcgctccgccgagatcgggctcgagttgatctccttacgcatcagcgtatcccagaactcgtcctggttcttgcatccggcatactgcaccgccatgcccacgaccgcaatgttatcgcacggcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaggtctagatcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 27 - DNA, 37334 bp, Artificial Sequence
  Plasmid pDAB110132
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctaggtcgacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggctagcactagtttaattaagcggccgctttgatcgaggaggaagatctaaacttggagaatgtctactattcagagatgaaagatgctggattctttgacgctgattgggaataaatcataacctgtatatacaatgtgataggattgtttataaatgaagctagtgtcatcttagggactactctttcacttatgtatctgttaatacaactctttcattttggattttagaaaaagaaaaagctttcatgtgtaacccaaaagttttcagtcgacaaatagagagagagatccatggcatacagattactaccaaagagtcgcttgacttgacatcataataaaagaaaatgacagaaagattatgaaaacaacaaagcctttggttcttctcttaatactaaaagggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcccacgagagagatctgctccaacgagagagagagatggcggagtgtacaaagagcgtgatgtcccgaggtagctcgttttcatttataagcttggtgcactctaaacgacgccgttacgtaataagatgggcctctctaggcctgttaagtcttaaattagcccatcattactaatgttcgtgtgaaggtaaacatatcacgtgccagattaacataattgaactgaaatgaaccatgtcaaaccggtcttaaccgagacataccagccgaattaaaatttatgggggccatagtgactgaatagtcaaaacatataaaccaaacagtacccatatcttaccaatcagatctgcggccgccctaggtctagatcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcttcaaagaaaactcctgtttgggaaatgagcaaggaagagctgttggatggcaagacggttgtctttgactacaacgagctgttggagtttgcggagggtgatgttggtcaagtgtttggaccagagtttgacatcattgacaagtacagaaggcgtgtgaggcttccagccagagaatacttgcttgtttcaagagtgactctcatggatgccgaggtgaataacttcagagttggctccagaatggtcactgagtatgatgttccagtcaatggtgagttgtcagagggaggtgatgttccctgggcagttcttgttgaaagtgggcagtgtgacttgatgctcatctcctacatggggattgacttccagtgcaaaggggaccgtgtttacagattgctcaacacatctctcaccttctttggggttgcccatgaaggagaaacccttgtgtatgacatcagagtcactggtttcgccaagggtgctggtggggaaatctcaatgttctttttcgagtatgactgctttgttgatggcagattgctcatagagatgagagatggttgtgctggcttctttactgatgccgaacttgccgctggaaaaggtgtgctcaaaacgaaggctgagcttgctgcacgtgctcagatccagaaacaagacattgcaccctttgcacctgcaccgtgcagtcacaaaaccagcttggatgccagagaaatgagactgcttgttgataggcaatgggcaagggtctttggttctggaatggctggcatagactacaagttgtgtgcgagaaagatgctgatgattgacagagtcacacaccttgatccgcgtggaggtgctcacggtcttgggcttctcattggggagaaagtgcttgagagggaccactggtacttcccctgccactttgtgagggatgaggtcatggctggttctcttgtctcagatggatgctctcagcttctcaaggtttacatgttgtggcttggccttcacaccactgttggtgcgttcgactttcgtccagtcagtggtcatgccaacaaagtgaggtgtcgtggacagatttcaccgcacaaggggaaacttgtttatgtcatggagatcaaagaaatgggctttgatgccaaaactggagatccatttgccatagctgatgttgacatcattgatgtcaactttgaagagggacaagcgtttgctggagttgaggatcttcacagctatggccaaggagatttgaggaaaaagatagttgtggatttcaagggaattgcgttgtcactgcagaaaaggaaggagcaacagaaagagagcatgactgtcaccactacgaccacgacaaccagcagagtgattgctcctccaagtggatgcctcaaaggtgatcccactgctcccacctctgtcacgtggcatccaatggctgagggaaatggaggtcctggacccactccgtccttctctccttcagcgtatcctcccagagctgtttgcttctctcctttccccaacaatccgcttgacaatgatcatacacctggccaaatgccgttgacctggttcaacatgtctgagttcatgtgtggaaaagtgagcaactgcttgggtcctgagtttgccagatttgatgcttccaagacatccagatcaccagcttttgacctggctcttgtgacaagggtgacgagtgtggctgacatggaacatggtcctttctacaatgtggatgtcaaccctggccaaggcacgatggtgggtgagtttgattgtcctgcagatgcttggttctttggagcctcaagcagagacgatcacatgccgtacagcatcttgatggagattgctcttcagacttctggagtcctcacatctgtgctcaaagctccgctcacaatggacaaagatgacatccttttcagaaaccttgatgcagatgcagaacttgtgggtgatgccatgcctgatgtcagagggaaaaccataaggaacttcaccaaatgcacgggatactccatgcttggcaagatgggaatccatcgtttcaccttcgaactctctgttgacggagcagttttctacaaagggagcacctcttttggttggtttgttcctgaggtctttgagagccagactggattggacaatggcaagccgaggttgccttggtatagggaaaacaatgtggcagtggacacactctcagcacctgcgtcagcttctagtgcccaaggtcagcttcagcttcagaggagagggtcacaagcgcagttcctggacacaattcatcttgctgggagtggagctggagtgcatggccaaggttatgctcatggggagaaagctgtgaacaagcaagattggttcttttcttgccatttctggtttgacccagtgatgcctgggtctttgggaattgagtccatgttccagcttgtggaagcgtggtgtgtcaaacaaggcttggctgcaaggcatggaattgctcatccagtctttgcacatgcacctggtgccaccagctggaagtacagaggtcagttgaccccaaagaatgacagaatggacagtgaagttcacatcaagagtgttgctgccttctcctcatgggttgatgtggttgctgatgggttcctcttcgttgatggcctcagagtctattcagcagacaacctgagggtcagaatccagactggagctggccatgttgaagagcaagaagttgctgccaaagccaccacaaagaactccagcattgctgatgtggatgtggctgatcttcaagctctcaaacaagcgttgctgacactggagagaccattgcagttggatgctggaagtgaggtgccagcctgtgctgtcagcgatttgggagaccgtggattcatggagacttatggggtggttgctccgttgtacagtggtgcgatggccaagggaatagcctctgcggatctggtcatagcaatgggtcagaggaagatgttggggagctttggagctggtgggttgccaatgcacgttgtccgtgctgggattgaaaagatccaagctgcacttcccgctggtccgtatgctgtcaacctcatccactcaccgttcgatgccaacctggaaaagggcaatgttgatcttttcctggaaaagggagttcgtgtggttgaggcgtctgccttcatggaactcacaccacaagtggtccgttacagagccacgggactctccagagatgcgagaggtggctcagtgaggacagcacacaagatcataggaaaggtttccagaacagagcttgcggagatgttcatcagacctgcacctcaagcaattctggacaaacttgttgcgtctggtgaaatcacccctgagcaagctgcgttggctcttgaagttccaatggctgatgacattgcagttgaggctgacagtggagggcacactgacaaccgtcccattcatgtcattctgccgttgatcctcagtctgaggaataggctccagagggaactcaagtaccctgccagacaccgtgttagggttggtgctggtggaggcataggttgtcctcaagctgcacttggagccttccacatgggagctgcgtttgttgtgactggcactgtcaaccagctgtcccgtcaagctggaacatgtgacaacgtgaggcgtcagctctctcgtgccacttactctgacatcacgatggcaccagctgcagacatgtttgaacaaggagttgaactgcaagttctcaagaaaggaacgatgttcccatctcgtgccaagaaactctttgaactgttccacaagtatgattcctttgaagcaatgcctgcggatgaattggctcgtgttgagaagaggatcttctccaagtcccttgcagaagtttgggcagagaccaaagatttctacatcactcgtctcaacaatcctgaaaagatcagaaaggctgagaatgaggaccccaagctcaagatgtccctctgcttccgttggtacttgggtctcagctcattctgggcaaacaatggcatagctgaccgtacgatggattaccagatttggtgtggacctgccataggagccttcaacgatttcattgcagacagctatcttgatgttgcagtctctggtgagttccctgatgttgtgcagatcaaccttcaaatcctgtctggtgctgcgtatctccagagattgctcagtgtcaaacttgcaccaaggatagatgtggacactgaagatgacctcttcacctacagaccagatcatgcactctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctaggtcgatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtcgacctcgaggctagcactagtttaattaagcggccgctaagtcaataacaaatcttaaaactgaactttattttttttattactgcttatcgttctttgcttctaaagagtcttcaccaaataaaagaacacttgcataatttagtgcatacaaaaatagtttcgaagtatctgatcaaaaccagatttgagtctttgttggatcccattggatgatcttttatcactagccttgaaggcttgattagacatctagaaaaagaaaatctgacatgttcaatagactagtactgcttcattgtgaatatagattaattgttttctttttggtgtatctgttgttaatcatcactttataggaaagtagcaagagtaaaaaaaaaaacttctcttttattaccgtctacggagtagttcttattacattagtacattatttatggaacacacaccatgactatgtagtgttaacatacatcaacaaccacactcatatcaccgtggtatacacactctcgaggatatttcgtttggaatggtgacctaagtgattaagctaactacttatacgatgatgtattctacgtcgtcgtcctgttgttgttgctgcacgcggcggtagtgcgaggctccgaggaggatgtgctggttgatgtccacgacgcgcggaaactcgccggtgccagcggtcgcgtccagcttggtgccgcgaacgaagtcgttgaagctgccgatggcggggccgcaccagatctggtagtccgccttgcgcgcggacgtcgcctcggtagcccatcgcgacgactgcgacatgtaccagcgcacacagagcgccatcctctcctgcggacttgcagcggtagcgtcgacaccaaacttttcgcgtgcagcagcccacacgtccgccacggactgcttgaacacggagcgctcgagcttgcgcagctgcggctccggcacggcgtcaaaggagccgaacttggcctgcagctgggcgagcatcgtggcccgcgcggcgaacatggtctgcttcttgagcacctggacgccgcccggcgccatggccacgtccgagtaggtggccgtcgccagcagtagtcggaccgcgtcgctggtgccagcctcgcgggccagttggttgacggacccggtgaccacaaaggcggcgcccagggaaaaggcgagcagcgcggcgcgcggacaggcgatcccgccgccggcgccgacgcgcactggcgtgtccaccaggtggcgccagcggttgcgctgcgccaccacgagcggcagcagcacgtggatcggtcggttgtcggtgtgcccgcccgagtcggcctccaccgcgacgtcgtcggccatggcgacgcggctggccagcgcggcctgctcgggcgtaatctgtttggcggcgaccaaagcctctagtacggcggccggcgccgggcgcagaaagtgctcggccacctcggtgcgcgacaccttggcgaccacacggtgagtcgccgacacagaagcaccgcaactagttcgtcgcagacccgtgacacggtagcgcaccaggtctgcagagagcgcgccggtgtagcccgatgcctcgacgattgagacgcccgtgcgcagcagcgcgtccaccgtcgcggcctcgtcaggacccggcatcaggttgacagcaaaggcgttggaggtgcgttgctggatctcacggatctggagttccacctggtccataggcaagcgggccgctccgaatgatgccagcatgcgggcctcggcggcagcgaccaccaggtctaccgacgagatgccttccgccatggcgcccatgtagagcggccagtccacgtcgtagcagcgcagaaaggcgtcatccccaaccaacaacgacgacgacgtctgcttggccttgaccacgggcgtcgaatcagcaaccacagcaccagcagcagcaaccacaactgccttggctgggtgcaaacgaaccatgcaatgcgtcgagggtttggcacttgcagcagcaacctgcttgctgatgccgtcggggcaaaagtacccgttgacctctacgctgcgaaggaagcggttgggcttgggcgggggctcctgcatcgcagagtcgatagccgtcaggaacgtggggtggtacaggtccgcaaacagagtcgggttgtgcaggggcacgcggtgggcggtcagcagcgccagcgacttgagggtctgcgtccacgccgactcactggggcggtccagcgccacggagacatgcggggtggcagccttgccaagaatgtcactgaccgcggcggagcgcatgttgttcggccccacctcgacgaagacatcgtggccgtcacggctgaccttgtcgacgatgcccggaaagtcggcgatgcgcgtgtacaacttctgcacgaactcggtgatgctgctgttgctgcccccgcgcagctcggcgttggtgaccgaggtgtacatcttgacggggctgtccggaatctccaaaatctcgtggatgtgcgcgatgcccggcgtgtagggcgccacttcggggcagtgcccaatcatgccttgcttgacgggcatcggcggcaaccgcccgcccaggcgctccagcacgcgcagacactcggcaggtttgccggcgatcagcgcgctgctcgagtcgttgacgatcagcaggcgcacgaagcggttgtcgggcccgatcgccttctcgatttcggcgcggctggcgcgaaccaagtagccctgccagaaggactccacgggggcgtccgccggcacgttccatagcttgcgcaaggcctggaactccaccgccagctgtgtcgaccacaccggcgaggtgcgtaggcgctgcgtgagctggtccgacaggccgcagttgcgtcgcgacagcgcaaagagcatggagatctcgccgaggctgaggccgaagcacgccttgggctgcaccccgagcacgtcgcgcgcgtagtcggtgaggcagatggacacgaagatgcccgtgcggaacatctcgatctggtccgcgtcaaaggccgtctgcacggcgcgctgcgagtcggcatccaccgcgcgcggcatgagccacgagtcgccgttctcccacagcgccgcggtcttgtcgttgatgcgctcgtgcaaagccggccacaggcggtgcaggtcgagcccgacgccgtagtaggggctgcggccctcgccgtacatgaacgcgacgcggtcgctggtcacaggtgtcggcgcaaaggcgctgcccgatggcgacatccagttgcgcccggccttggcgcttcgcggtacacccttggctgccagctccaactccttctccagcttctccggcgttgtcagcagggccaaacacaaggtcgccgtggcaccgtgactagccaccgtctcccctacgagccgcaaaaagcgcaagcgatgagcagtgaaagcgacagcagcagctgggtcgtcgtcagtagcagacccggtttcggcgtgcgctcggaggagcgccagctcggcgttgaccttggccatgatatcgtcaacggtgtcgccacggatcgcgatgagcttgggggcggcgtcatccagcgagaggcggttgctgctctcatgagtggcgtactcgtctgtgaggagcacgccaaagcaggacccgctctcggaggcactggcgacagccgccagtcgcgactcgcccgggttcttcagccaggcacgcgagcgcgggcaagtaaacagcgcctcggagaccggcgccaccggccgctcccactgcgggttggccgggaggtagcggttgtggaggcacagcgccgtcttgatgaggctcgcggcgcccgaggcgtacccgacgtctcccacgttggcgcgcacgctgccgatggccaccgagcccggcacctggtgcgcgagcaacttggacacttgctccagctgcgactcggcgctcagcggcgagttggccaagtgcggcgcatggcgacccgagtcggcggcgagctccaccatctccaccaccctcttctcgttgtcgtcgttgtggacttggagtagtagcggcgacacggcttcagcgggctgcgcggcgcacgtgaggcccgcgacactggcgtagaccttgtcgtctgagccaacgtcggcctggcgcttgaggaccagggcgccgctgccctcgccggcaaagtacccgtcggcgctggcctcaaagttggcgcgagggtggtcctgtcggctgatggcggagcggcgcgccttgaggtaaaggttctcggcggtggcacagaggtcgacgccggccaccacgacggcgtccacctggtgcgtgtcgagcaggaacttgcccagctcgaggcagcggtagaccgagtttgcgccttcggtgacggtgaaggacgggcccgtaaagccccactgcgaggacacgcgcgtggccacgaggttgccgatgtacgacgtgtacgacgtcgaggtgccgcagtcgttgatgtagtccatcatctcctgcacctgctcgggcgagaacgcggccgggtcgagccgctccttgagtgtcacgcgcgcgcggtgccggtacagctcggtgtccgtgccgagccccaccagcaccgccaccttgcctcccgtcgccattccagcgtcctgcagcgcgcggtccatcgtagccaccgccagcagctgttgcgggcgcaggacgtcctcagggatcatcggcgaccgcagccgcttgtagtccacgtccacgtcgcgcacgtagcacccgcgcggcacggcgtcgaggcccatggcggtcaagaagtccgtgtcggcgcccaggaaccgccagcgcttgctcggcaggtcgctggcgccgtccgtgcccttgtagatggcctgctcaaacgcgtccaggcccttgagggtaccaaacgtcgcgtccatcccgatgatggcaatcggtccaggagtcacctcgggaagcaccggcgaggctgtcgcagtagcagcaatttggcggtgctcacggaagacacagtgcgcgttggttccaccaaagccaaaggcggagagcgaggcgcacttgagctcatcgcctggtttgcctgcccgcgcctgcgccgacgagtacggccaagggatggcctcgtccacgacgagcgggtcgatgcagttggagcggtcgacaccgggcgtgggcgggatcgtgccgtgctgcatcgacagcagcaccttggccatgcctgcgaacccggccgccacgagagtgtggccaaagttgcccttggtggagcccatgcgcggcgggtggtccgtgttacctcgaaagcagtggcgcagcgcctctacctccacgacgtcgccctgcggagtgcccgtggcgtggcactccacgtactgcacctcgcttgggtcgatgccgacgctcgtgtacaggtcctccatgcacgacttctcgctcggcaggtgcgggctcagcggcaggccgcacccggcgttgctcagactcgtgccgagcaaggtgccgtagatgcggtcgccgtcgcgcacggcgtcctcgaggcgcttcagcaccatgatggcgccgccctctccgggcgtcaggccctggctgccctgccgcagcggcacggacagtgggttatcgtccggtccgcccagcggcatcgcctggaaggtggagaaccccgagagaatgaagaacgggtccggaaagcatgtggcgccgcacagcatcacgtccgcgctgcgcgagagcaagtggtcggacgccagcttgaggcagtacagcgccgacgcgcaggctgcatcgaggctgtagcgcacgggccccaggccgagctggttggccacgaaggacgccgggtcggagtacacgcgcgggtcgctggcctcgggcgagacagcgcgcgggcgctccgaccaggggcgcgagtcgcggaagcgctgggcgcccacgcggttctccacatgcacttggtacagattgagcagctcgccctgcagattgtccatggggaacgacaggcagccgctcacgatgccgaagtcgcgtaggttggcggtggtgctggcgtcgtcgaggttaattccggcgtcgagcagggcgcgccgggccaggtcggcgaggaggtcgtgctcgttgtcgacgctggcatcgacgcagccgtagcgatcgttgcagaaggtgtcggcgtacttgctgcgctgcgggtggaagtggaggtcgcggtagcgcgtaccgaggcgctccgccgagatcgggctcgagttgatctccttacgcatcagcgtatcccagaactcgtcctggttcttgcatccggcatactgcaccgccatgcccacgaccgcaatgttatcgcacggcatttttggttgtggatccgatcttgtagtgatgagttttggtttgagtaaaaagtgaagccgagcctctaatttataggtgagaatggagatttgcatggcgatcacgtgtaaatattgcatgcatatgtgtgtgtgctgtgagagagaagctcttttaggtgtttgaagtgagtgacaaatcgtccgcatctgcatgctaatatgtgatgtgtagctcatgtcctggcgtgacatcttatgaacgatatttttcaaaaaagaaggtaaaaacttaaacttcaaaaaataaaaacttaatgagaattcagaacatagtccacaagtcattaccttgaagaaatgttttttttagtgtgatagattcagcacaattggcacagaaggtggcaactccgagtgattcgacattattaaaaatataagatttgaatattttggtttggtgtggctttctcacattgcacttatcagatattcagacactgagaaagaaacagaaacatatctaaagacgcattaaacaacgcaaatggatgatatcaataagataaaagcacacacttgaagggctttaaaaagctctcaaatctttctactactcaattgcatcttctcttttgttactcgtacatacataccaagacacatccctttcatcacattcaaccaaagagactgcgtctggttttacgtctttgattggtattatgacgaccctgaggctcgctccaattgtcttcggctttctaacacaacacatgatgcttaagtgtgtatcatcagcacactgtcctgccatagcatattgatgcaatgtacagattcttcgcccatttgtcctgaaaaaaaaaaaattcaaccaaaagctctcaggtcctatgtatatggaaacaaaacaaaaagatccaaatctgtgttcaaagctaaagaaaccaaccttgacatgagtacttggaaaggcggtggtgcggagagtctcttgagtttcatccaccatcttacgctttggtatgcttaatatgaaagctgcttgatccgcagttgctgccattgatgttattctatacccattctcccacctcctatgtatcccatcgcttgggtacaaaaagtcaagctccaccacctttcacaacgcagagtttatcatattagactatcaggggaaaataaaaacaccagacaataagagacaaaaacctacctgatcagagaagccagagttcctcgacattaccacaccccaacgattaccagcagttgtcatggaggttacatgaaaatcttctttccatttcttatttatccacttgaatggaaatgagtcactcactttgtatgactgctgagaataagtagttcctaccaattcacaacaagtatataaataagtcaatgaagactttttgataataagtttattattcactaaacactaaccttttgacataacaactaaagagctcccgttatctgaacccgctatggagcttatatagtagttcttttcccattgttccataatccagtcctgcggggaaatcataaggtaagttcttcttagtttactacaaatcagattgattcttaattgcttcaactgattattaccttgtgtaggaagaccggtgacaactcataaacttgagaagtgaatccagttccagcatccatgatgagagcccagagattagctgctgatgctacacagctaatcaaaaggccatcttcatttcccttctgtatatgctggcgcagccttgtctctccaacattgtagtgatatctaccaaaagattacacagttagtgaggaactatcaaagtgtatatgcaaaaaatgtgttacctctgtttcatgggacgacgaccgttatagactgagatccattgagtagcaggactgcctattcttattttcttcttcggctgttcatcatcttccaaattgagaagcaatcttcctcgtttttgcccaacctacatatgccaaaagaagcactttcagagaatatttatacacaagtttagaagttaatcatatgaacaagaaaacagccagcaacctttagagctccatcaattctaattggtctagatagagcgcacggctcaattagagtatcgaaaagagaaataagctgcggccgcttaattaacctaggtctagatcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 28 - DNA, 37330 bp, Artificial Sequence
  Plasmid pDAB107961
ccgggttcctgggcaacgtcacggcggggcgctgctgcaataccttcaacatggagggcatgaactgcgtcgtggacgcggcctgcgcgtcgtcgctgatcgcggtcaaagtggcgatcgaggagctgctctacggcgactgcgatgcgatgatcgcgggtgccacctgcacggacaactcgatcgggatgtacatggccttctccaagacgcccgtgttttccacggacccgagcgtcaaggcgtacgacgccgccaccaaaggcatgctcatcggcgagggctcggcgatgctcgtgctgaagcgctacgcggacgccgtgcgcgacggcgacaccgtgcacgccgtcatcaaggggtgcgcgtcctcgagcgacggcaaggcggcgggcatctacacgccgacaatctcgggccaggaggaggccctgcgccgcgcctacgcccgcgccaatgtcgacccggccactgtgacgctggtggagggccacggcacgggtacgccggtgggcgacaagatcgagctgacggcgctgagcaacctcttctccaaggcgttttctgccaacggtggcggcgcggaggaagcagagcaggtggcggtgggcagcatcaagtcgcagatcgggcacctcaaggcggtggccgggctggccgggctggtcaaggtggtgctggcgctcaagcacaagacgctgccgcagacgatcaacgtcgacaagccgccgtcgctggtggacgggaccccgatccagcagtcgccgctgtacgtcaacacgatgaaccgcccctggttcacgcccgtaggggtgccgcgccgcgccggcgtgtcgtcgtttgggtttggcggtgccaactaccacgccgtgctggaggagtttgagcccgagcacgagagcgcgtaccggtacaacaacctgccgcaggtggcgctgctgcacgcgggggacgtcgcgaccttggcggcgacggttcgcgccaagctggcgctggccaccgccgagcaggaagaggcgcgtgtggtgaagaacgcggactacatcgcgtaccaccggttcctggacgagtgcaagttgcgcggcgctgtgccgcaggcgcacgcgcgggtgggactgctcgtacgggacctgagctcgctcatcgccgtgctcgaggccgctgccgccaagctcgcgggcgaagagagcgcgacggagtggacggtcagcgttgctacgggcgaggcggccttccgcgtgcgcggtgtggctacggaggccaacgtggcggcgctgttctcgggccagggcgcgcagtacacgcacatgttcagcgacgtggcgatgaactggcccccgttccgcgagagcgtcgccgccatggaccgcgcccagcgcgagcgcttcgggcggcctgccaagcgcgtgagcagcgtgctgtacccgcgcaagccgtacggcgacgaaccgcggcaggaccacaaggagatctcgcaaacgcgctactcgcagcccgcaacgctcgcgtgctcggtcggcgcctttgacatcttcaaagcggcgggactggcgccgagctttgcggcgggccactcgctgggcgagtttgcggcgctctacgcggccgggtcgctcgatcgcgacgccgtcttcgacctggtctgcgcgcgcgccaaggccatgagcgacttcacggcccaggccagcagcagcggtggcgccatggcggccgtgattggcgccaaggcggaccagctctcgctgggtggcgcgcccgacgtgtggctcgccaacagcaactcgccctcgcagaccgtgatcacgggaaccgccgaagcagtggctgcggcctctgacaagttgcgctgcagcggcaacttccgcgtcgtgcctctggcctgcgaggcggccttccactcgccgcacatgcgcggcgcggagcagacgtttgcgtcggcgctcgcgcaggcgcccgtgtcggcaccggcggctgctcggttctactctaacgtgacggggggcgccgcggtaacctcgcccgcggacgtcaaaacgaacctgggcaagcacatgacgagccctgtgcagttcgtgcagcaggtgcgagccatgcacgcggcgggcgcgcgtgtgtttgtggagtttgggcccaagcaggtcctgtcgcgcctcgtcaaggagacccttggcgaggccggcgacgtggtcacggtcgccgtcaacccagactcggccaaggacagcgacacgcagctgcgccaggcggcgctcacgttggcggtcgccggcgtgccgctcaaggactttgaccgctggcagctgccggatgccacgcgcctcgagcctgtcaagaagaagaagaccacgttgcggctctcggcagccacctacgtctccgccaagacgttgcgccagcgcgaggccgtgctcaacgacggctacactgtcagtggtgccacggcggtagtcaaggaagtggacacggccaacgaggagcgtctcgtccgccaagcccaggatctccagcgccagctcgcggaggcctcgacggcagcccaggcggcgcagtccaaggtcgcggagctcgagcgcacgatccaggacttggagcgcaaggtgcagcagcagcagcaagagaagggtgagaactcagacagcaacgctgccgccgaagtgctgcggcgccacaaggagctgctccagcgcatgctgcaggactgtgacgagcaggcagtgcccgtagccacggtggttccgacacctacgtcctccccgacgcctacatcctcacccgtatccggcaacagcaagagcactcgtggcagtgctgatctgcaagcgctgctggccaaggcggagactgtggtgatggctgtgctggctgccaagactggctacgaggccgacatggttgaggcggacatggacctggaggccgagctcggcatcgactcgatcaagcgcgtggagatcctttccgaggtgcagggccagctgggcgtcgaggccaaggacgtggatgcgctgagccgcacgcgcacggtcggtgaggttgtggacgccatgaaggcggagatcgtggctgcctctggtggtagtgctcctgcggttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctgctggtagtgctcctgctcctgctgttccttcggcgcccgctgcttctgcagctccgactcccgctgcttcgactgcgccttctgctgatctgcaagcgctgctgtccaaggcggagacggtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctcctgcggttccttcggcgcccgctgcttctgcagctccgactcccgcggctgcgacagcgccttctgctgatctgcaagcgctgctggccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaggttgtggatgccatgaaggcggagatcgtggctgcctctgctggtagtgctcctgctcctgctgttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctgctgctgttccttcggcgcccgctgcttctgcagctccgactcctgcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaagtggtggacgccatgaaggcggagatcgtggctgcctctggtggtagtgctcctgctgctccttcggcgcccgcgcttcttccaacgctgtttggttccgagtgcgaggacctgtctctgacctttcccgtgataacgaccctgccgcttcctgcagagcttgtgctggccgagggcggcgctcgccctgtagtcgtggtggatgatggatctgcactcacctcgtcgctggtgtcctcgctcggcgatcgtgcggtgctgctgcaggtgcagtcttcctctgcctgctcgccgcgctcgaccacgcacaagttggtgaccgtagcagaccgctctgaagcggcgctacaggcggcgctcacgtccgtcgaggcgcagttcggcaaggtgggtggctttgtgttccagttcggcgacgacgacgtgcaagcgcagctcggctgggcgctgctcgcggccaagcacctcaaaacttcgctgtcagaacagatcgagggcggtcgcacctttttcgtggccgtcgcgcggctcgacggccagctggggctctccggcaagtcgacgaccgctaccgttgatctctcccgcgcgcagcagggcagcgtgttcggcctgtgcaagacactcgacctggagtggcccgctgtcttctgccgcggaatcgacctggccgccgacctcgacgccgcacaggccgcgcggtgcctgctgggcgagctgtcagaccccgacgtggccgtgcgcgagtctggttactccgcctcgggccagcgctgcacgacaactacgaagtcgctgactacgggcaagccgcaccagccgatctcctcgtcggacctctttctggtgtcgggcggcgcgcgcggcatcaccccgctgtgcgtgcgcgagctggcgcagcgcgtgggcggcggcacgtacgtgctcatcggccgctcggagctgcccacgacggagcctgcctgggcggtcggcgtggagtctggcaagccgctggagaaggccgcgctggcgttcctgaaggcggagtttgcagcgggccgcggggccaagccgacgccgatgctgcacaagaagctcgtgggcgccgtggtcggagcgcgcgaggtgcgagcctcgctcgccgagatcactgcacagggcgccacggctgtgtacgagtcgtgcgacgtgagctctgccgccaaggtgcgtgagatggtagagcgcgtgcagcagcagggcgggcggcgcgtgtcgggcgtgttccacgcgtcgggcgtgctgcgcgacaagctcgtggagaacaagtcgctggcggacttcagcgccgtgtacgacaccaaggtgggcggcctcatcaacctgctggcctgcgtggacctggcgcagctgcgtcacctcgtgctcttcagctcgctcgcgggcttccacggcaacgtcgggcagtcggactacgcaatggccaacgaggcgctcaacaagctggcggcgcacctgtcggcggtgcacccgcagctgtgcgcgcgctcgatctgcttcggaccgtgggacggcggcatggtgacccccgcgctcaaggccaacttcatccgcatgggcatccagatcatcccgcgccaaggcggcgcgcagaccgtcgccaacatgctcgtcagtagctcccccggtcagctgctcgtgggcaactggggcgtgccacccgtcgtgccgagtgccaccgagcacaccgtgctgcagacgctccgccagagcgacaaccccttcctcgactcgcacgtgatccagggccgccgcgtgctgcccatgaccctggccgtgggctacatggcgcaccaggcgcagagcatctacgcgggccaccagctgtgggccgtcgaggacgcccagctcttcaagggcatcgccatcgacaatggcgccgacgtgcccgtgcgcgtggagctgtcgcgccgcaaggaggagcaggaggacgccggcaaggtcaaggtcaaggtgcaggtgctgctcaaatcgcaggtcaacggcaagtcggtgcccgcgtacaaggcgaccgtcgtgctgtcccctgcgccgcgccccagcgtcatcacgcgtgacttcgacctcaccccggacccggcctgcacggagcacgacctctacgacggcaagacgctcttccacggcaaggccttccagggcatcgagcaggtgctctcggcgacgcccaagcagctcaccgccaagtgccgcaatttgcccctcacgcccgagcagcgcggccagttcgtcgttaacctcagccagcaggacccgttccaggcggacattgcgttccaggcgatgctcgtctgggcgcgcatgctgcgccaatcggcggccctgcccaacaactgcgagcgcttcgacttttacaagccgatggccccgggcgccacctactacacgtcggtcaagctggcctcggcctcacccttggtggactctgtgtgcaagtgcaccgtggcgatgcacgatgagcaaggtgaggtgtacttttctgctcgtgccagcgtcgtcctcaacaagaccctcacgtactaagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctaggtcgacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggctagcactagtttaattaagcggccgctttgatcgaggaggaagatctaaacttggagaatgtctactattcagagatgaaagatgctggattctttgacgctgattgggaataaatcataacctgtatatacaatgtgataggattgtttataaatgaagctagtgtcatcttagggactactctttcacttatgtatctgttaatacaactctttcattttggattttagaaaaagaaaaagctttcatgtgtaacccaaaagttttcagtcgacaaatagagagagagatccatggcatacagattactaccaaagagtcgcttgacttgacatcataataaaagaaaatgacagaaagattatgaaaacaacaaagcctttggttcttctcttaatactaaaagggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcccacgagagagatctgctccaacgagagagagagatggcggagtgtacaaagagcgtgatgtcccgaggtagctcgttttcatttataagcttggtgcactctaaacgacgccgttacgtaataagatgggcctctctaggcctgttaagtcttaaattagcccatcattactaatgttcgtgtgaaggtaaacatatcacgtgccagattaacataattgaactgaaatgaaccatgtcaaaccggtcttaaccgagacataccagccgaattaaaatttatgggggccatagtgactgaatagtcaaaacatataaaccaaacagtacccatatcttaccaatcagatctgcggccgccctaggtctagatcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcatcgaagaagatcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctaggtcgatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtcgacctcgaggctagcactagtttaattaagcggccgctaagtcaataacaaatcttaaaactgaactttattttttttattactgcttatcgttctttgcttctaaagagtcttcaccaaataaaagaacacttgcataatttagtgcatacaaaaatagtttcgaagtatctgatcaaaaccagatttgagtctttgttggatcccattggatgatcttttatcactagccttgaaggcttgattagacatctagaaaaagaaaatctgacatgttcaatagactagtactgcttcattgtgaatatagattaattgttttctttttggtgtatctgttgttaatcatcactttataggaaagtagcaagagtaaaaaaaaaaacttctcttttattaccgtctacggagtagttcttattacattagtacattatttatggaacacacaccatgactatgtagtgttaacatacatcaacaaccacactcatatcaccgtggtatacacactctcgaggatatttcgtttggaatggtgacctaagtgattaagctaactacttatacgatgatgtattctacgtcgtcgtcctgttgttgttgctgcacgcggcggtagtgcgaggctccgaggaggatgtgctggttgatgtccacgacgcgcggaaactcgccggtgccagcggtcgcgtccagcttggtgccgcgaacgaagtcgttgaagctgccgatggcggggccgcaccagatctggtagtccgccttgcgcgcggacgtcgcctcggtagcccatcgcgacgactgcgacatgtaccagcgcacacagagcgccatcctctcctgcggacttgcagcggtagcgtcgacaccaaacttttcgcgtgcagcagcccacacgtccgccacggactgcttgaacacggagcgctcgagcttgcgcagctgcggctccggcacggcgtcaaaggagccgaacttggcctgcagctgggcgagcatcgtggcccgcgcggcgaacatggtctgcttcttgagcacctggacgccgcccggcgccatggccacgtccgagtaggtggccgtcgccagcagtagtcggaccgcgtcgctggtgccagcctcgcgggccagttggttgacggacccggtgaccacaaaggcggcgcccagggaaaaggcgagcagcgcggcgcgcggacaggcgatcccgccgccggcgccgacgcgcactggcgtgtccaccaggtggcgccagcggttgcgctgcgccaccacgagcggcagcagcacgtggatcggtcggttgtcggtgtgcccgcccgagtcggcctccaccgcgacgtcgtcggccatggcgacgcggctggccagcgcggcctgctcgggcgtaatctgtttggcggcgaccaaagcctctagtacggcggccggcgccgggcgcagaaagtgctcggccacctcggtgcgcgacaccttggcgaccacacggtgagtcgccgacacagaagcaccgcaactagttcgtcgcagacccgtgacacggtagcgcaccaggtctgcagagagcgcgccggtgtagcccgatgcctcgacgattgagacgcccgtgcgcagcagcgcgtccaccgtcgcggcctcgtcaggacccggcatcaggttgacagcaaaggcgttggaggtgcgttgctggatctcacggatctggagttccacctggtccataggcaagcgggccgctccgaatgatgccagcatgcgggcctcggcggcagcgaccaccaggtctaccgacgagatgccttccgccatggcgcccatgtagagcggccagtccacgtcgtagcagcgcagaaaggcgtcatccccaaccaacaacgacgacgacgtctgcttggccttgaccacgggcgtcgaatcagcaaccacagcaccagcagcagcaaccacaactgccttggctgggtgcaaacgaaccatgcaatgcgtcgagggtttggcacttgcagcagcaacctgcttgctgatgccgtcggggcaaaagtacccgttgacctctacgctgcgaaggaagcggttgggcttgggcgggggctcctgcatcgcagagtcgatagccgtcaggaacgtggggtggtacaggtccgcaaacagagtcgggttgtgcaggggcacgcggtgggcggtcagcagcgccagcgacttgagggtctgcgtccacgccgactcactggggcggtccagcgccacggagacatgcggggtggcagccttgccaagaatgtcactgaccgcggcggagcgcatgttgttcggccccacctcgacgaagacatcgtggccgtcacggctgaccttgtcgacgatgcccggaaagtcggcgatgcgcgtgtacaacttctgcacgaactcggtgatgctgctgttgctgcccccgcgcagctcggcgttggtgaccgaggtgtacatcttgacggggctgtccggaatctccaaaatctcgtggatgtgcgcgatgcccggcgtgtagggcgccacttcggggcagtgcccaatcatgccttgcttgacgggcatcggcggcaaccgcccgcccaggcgctccagcacgcgcagacactcggcaggtttgccggcgatcagcgcgctgctcgagtcgttgacgatcagcaggcgcacgaagcggttgtcgggcccgatcgccttctcgatttcggcgcggctggcgcgaaccaagtagccctgccagaaggactccacgggggcgtccgccggcacgttccatagcttgcgcaaggcctggaactccaccgccagctgtgtcgaccacaccggcgaggtgcgtaggcgctgcgtgagctggtccgacaggccgcagttgcgtcgcgacagcgcaaagagcatggagatctcgccgaggctgaggccgaagcacgccttgggctgcaccccgagcacgtcgcgcgcgtagtcggtgaggcagatggacacgaagatgcccgtgcggaacatctcgatctggtccgcgtcaaaggccgtctgcacggcgcgctgcgagtcggcatccaccgcgcgcggcatgagccacgagtcgccgttctcccacagcgccgcggtcttgtcgttgatgcgctcgtgcaaagccggccacaggcggtgcaggtcgagcccgacgccgtagtaggggctgcggccctcgccgtacatgaacgcgacgcggtcgctggtcacaggtgtcggcgcaaaggcgctgcccgatggcgacatccagttgcgcccggccttggcgcttcgcggtacacccttggctgccagctccaactccttctccagcttctccggcgttgtcagcagggccaaacacaaggtcgccgtggcaccgtgactagccaccgtctcccctacgagccgcaaaaagcgcaagcgatgagcagtgaaagcgacagcagcagctgggtcgtcgtcagtagcagacccggtttcggcgtgcgctcggaggagcgccagctcggcgttgaccttggccatgatatcgtcaacggtgtcgccacggatcgcgatgagcttgggggcggcgtcatccagcgagaggcggttgctgctctcatgagtggcgtactcgtctgtgaggagcacgccaaagcaggacccgctctcggaggcactggcgacagccgccagtcgcgactcgcccgggttcttcagccaggcacgcgagcgcgggcaagtaaacagcgcctcggagaccggcgccaccggccgctcccactgcgggttggccgggaggtagcggttgtggaggcacagcgccgtcttgatgaggctcgcggcgcccgaggcgtacccgacgtctcccacgttggcgcgcacgctgccgatggccaccgagcccggcacctggtgcgcgagcaacttggacacttgctccagctgcgactcggcgctcagcggcgagttggccaagtgcggcgcatggcgacccgagtcggcggcgagctccaccatctccaccaccctcttctcgttgtcgtcgttgtggacttggagtagtagcggcgacacggcttcagcgggctgcgcggcgcacgtgaggcccgcgacactggcgtagaccttgtcgtctgagccaacgtcggcctggcgcttgaggaccagggcgccgctgccctcgccggcaaagtacccgtcggcgctggcctcaaagttggcgcgagggtggtcctgtcggctgatggcggagcggcgcgccttgaggtaaaggttctcggcggtggcacagaggtcgacgccggccaccacgacggcgtccacctggtgcgtgtcgagcaggaacttgcccagctcgaggcagcggtagaccgagtttgcgccttcggtgacggtgaaggacgggcccgtaaagccccactgcgaggacacgcgcgtggccacgaggttgccgatgtacgacgtgtacgacgtcgaggtgccgcagtcgttgatgtagtccatcatctcctgcacctgctcgggcgagaacgcggccgggtcgagccgctccttgagtgtcacgcgcgcgcggtgccggtacagctcggtgtccgtgccgagccccaccagcaccgccaccttgcctcccgtcgccattccagcgtcctgcagcgcgcggtccatcgtagccaccgccagcagctgttgcgggcgcaggacgtcctcagggatcatcggcgaccgcagccgcttgtagtccacgtccacgtcgcgcacgtagcacccgcgcggcacggcgtcgaggcccatggcggtcaagaagtccgtgtcggcgcccaggaaccgccagcgcttgctcggcaggtcgctggcgccgtccgtgcccttgtagatggcctgctcaaacgcgtccaggcccttgagggtaccaaacgtcgcgtccatcccgatgatggcaatcggtccaggagtcacctcgggaagcaccggcgaggctgtcgcagtagcagcaatttggcggtgctcacggaagacacagtgcgcgttggttccaccaaagccaaaggcggagagcgaggcgcacttgagctcatcgcctggtttgcctgcccgcgcctgcgccgacgagtacggccaagggatggcctcgtccacgacgagcgggtcgatgcagttggagcggtcgacaccgggcgtgggcgggatcgtgccgtgctgcatcgacagcagcaccttggccatgcctgcgaacccggccgccacgagagtgtggccaaagttgcccttggtggagcccatgcgcggcgggtggtccgtgttacctcgaaagcagtggcgcagcgcctctacctccacgacgtcgccctgcggagtgcccgtggcgtggcactccacgtactgcacctcgcttgggtcgatgccgacgctcgtgtacaggtcctccatgcacgacttctcgctcggcaggtgcgggctcagcggcaggccgcacccggcgttgctcagactcgtgccgagcaaggtgccgtagatgcggtcgccgtcgcgcacggcgtcctcgaggcgcttcagcaccatgatggcgccgccctctccgggcgtcaggccctggctgccctgccgcagcggcacggacagtgggttatcgtccggtccgcccagcggcatcgcctggaaggtggagaaccccgagagaatgaagaacgggtccggaaagcatgtggcgccgcacagcatcacgtccgcgctgcgcgagagcaagtggtcggacgccagcttgaggcagtacagcgccgacgcgcaggctgcatcgaggctgtagcgcacgggccccaggccgagctggttggccacgaaggacgccgggtcggagtacacgcgcgggtcgctggcctcgggcgagacagcgcgcgggcgctccgaccaggggcgcgagtcgcggaagcgctgggcgcccacgcggttctccacatgcacttggtacagattgagcagctcgccctgcagattgtccatggggaacgacaggcagccgctcacgatgccgaagtcgcgtaggttggcggtggtgctggcgtcgtcgaggttaattccggcgtcgagcagggcgcgccgggccaggtcggcgaggaggtcgtgctcgttgtcgacgctggcatcgacgcagccgtagcgatcgttgcagaaggtgtcggcgtacttgctgcgctgcgggtggaagtggaggtcgcggtagcgcgtaccgaggcgctccgccgagatcgggctcgagttgatctccttacgcatcagcgtatcccagaactcgtcctggttcttgcatccggcatactgcaccgccatgcccacgaccgcaatgttatcgcacggcatttttggttgtggatccgatcttgtagtgatgagttttggtttgagtaaaaagtgaagccgagcctctaatttataggtgagaatggagatttgcatggcgatcacgtgtaaatattgcatgcatatgtgtgtgtgctgtgagagagaagctcttttaggtgtttgaagtgagtgacaaatcgtccgcatctgcatgctaatatgtgatgtgtagctcatgtcctggcgtgacatcttatgaacgatatttttcaaaaaagaaggtaaaaacttaaacttcaaaaaataaaaacttaatgagaattcagaacatagtccacaagtcattaccttgaagaaatgttttttttagtgtgatagattcagcacaattggcacagaaggtggcaactccgagtgattcgacattattaaaaatataagatttgaatattttggtttggtgtggctttctcacattgcacttatcagatattcagacactgagaaagaaacagaaacatatctaaagacgcattaaacaacgcaaatggatgatatcaataagataaaagcacacacttgaagggctttaaaaagctctcaaatctttctactactcaattgcatcttctcttttgttactcgtacatacataccaagacacatccctttcatcacattcaaccaaagagactgcgtctggttttacgtctttgattggtattatgacgaccctgaggctcgctccaattgtcttcggctttctaacacaacacatgatgcttaagtgtgtatcatcagcacactgtcctgccatagcatattgatgcaatgtacagattcttcgcccatttgtcctgaaaaaaaaaaaattcaaccaaaagctctcaggtcctatgtatatggaaacaaaacaaaaagatccaaatctgtgttcaaagctaaagaaaccaaccttgacatgagtacttggaaaggcggtggtgcggagagtctcttgagtttcatccaccatcttacgctttggtatgcttaatatgaaagctgcttgatccgcagttgctgccattgatgttattctatacccattctcccacctcctatgtatcccatcgcttgggtacaaaaagtcaagctccaccacctttcacaacgcagagtttatcatattagactatcaggggaaaataaaaacaccagacaataagagacaaaaacctacctgatcagagaagccagagttcctcgacattaccacaccccaacgattaccagcagttgtcatggaggttacatgaaaatcttctttccatttcttatttatccacttgaatggaaatgagtcactcactttgtatgactgctgagaataagtagttcctaccaattcacaacaagtatataaataagtcaatgaagactttttgataataagtttattattcactaaacactaaccttttgacataacaactaaagagctcccgttatctgaacccgctatggagcttatatagtagttcttttcccattgttccataatccagtcctgcggggaaatcataaggtaagttcttcttagtttactacaaatcagattgattcttaattgcttcaactgattattaccttgtgtaggaagaccggtgacaactcataaacttgagaagtgaatccagttccagcatccatgatgagagcccagagattagctgctgatgctacacagctaatcaaaaggccatcttcatttcccttctgtatatgctggcgcagccttgtctctccaacattgtagtgatatctaccaaaagattacacagttagtgaggaactatcaaagtgtatatgcaaaaaatgtgttacctctgtttcatgggacgacgaccgttatagactgagatccattgagtagcaggactgcctattcttattttcttcttcggctgttcatcatcttccaaattgagaagcaatcttcctcgtttttgcccaacctacatatgccaaaagaagcactttcagagaatatttatacacaagtttagaagttaatcatatgaacaagaaaacagccagcaacctttagagctccatcaattctaattggtctagatagagcgcacggctcaattagagtatcgaaaagagaaataagctgcggccgcttaattaacctaggtctagatcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggatactcgcatcgcgatcgtggggatgtcggcgatcctgccgagcggggagaacgtgcgcgagagctgggaggcgatccgcgatgggctggattgcctgagcgatctgccggcggaccgcgtggacgtgacggcctactacaacccggagaagacgaccaaggacaagatctactgcaagcgcggcgggttcatcccggagtacgacttcgacgcgcgtgagttcgggctcaacatgttccagatggaggactcggacgccaaccagacgatctcgctgctcaaggtgaaggaggcgctgacggacgccaacatcccggcgttctcgagcggtaagaagaacatcggctgcgtgctgggcatcggcggcggccagaaggcgagccacgagttctactcgcggctcaactacgtggtcgtggacaaggtgctgcgcaagatgggcctgccggaggaagacgtggcggcggcggtggacaagtacaaggcgagtttccccgagtggcgcctcgactctttcc

SEQ ID NO: 29 - DNA, 38465 bp, Artificial Sequence
  Plasmid pDAB110151
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgacacaactttgtatacaaaagttgtctagacctaggctcagcaactcatccagtcaagttcgagtcagtgagttgggcggccgcgaattcggcgcgccaaccttggactcccatgttggcaaaggcaaccaaacaaacaatgaatgatccgctcctgcatatggggcggtttgagtatttcaactgccatttgggctgaattgaagacatgctcctgtcagaaattccgtgatcttactcaatattcagtaatctcggccaatatcctaaatgtgcgtggctttatctgtctttgtattgtttcatcaattcatgtaacgtttgcttttcttatgaattttcaaataaattatcgatagtactacgaatatttcgtatcgctgatcttctcaatcacaatgatgcgtagtgacccgacaaataatttaagcgtccttaataccaatcctaaaataattgaggcaaataaaatttttttgtaatttttatgatagcagatcgattctccagcaagcctgcaacaaaatattgtgtatttctaaatagattttgatactcgaggtgaccgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaatctgacctgaccactagacctgagtgagtacagatgtgctactagtgctagcctcgaggtcgaccaacttttctatacaaagttgtctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatgacatcttcaaagaaaactcctgtttgggaaatgagcaaggaagagctgttggatggcaagacggttgtctttgactacaacgagctgttggagtttgcggagggtgatgttggtcaagtgtttggaccagagtttgacatcattgacaagtacagaaggcgtgtgaggcttccagccagagaatacttgcttgtttcaagagtgactctcatggatgccgaggtgaataacttcagagttggctccagaatggtcactgagtatgatgttccagtcaatggtgagttgtcagagggaggtgatgttccctgggcagttcttgttgaaagtgggcagtgtgacttgatgctcatctcctacatggggattgacttccagtgcaaaggggaccgtgtttacagattgctcaacacatctctcaccttctttggggttgcccatgaaggagaaacccttgtgtatgacatcagagtcactggtttcgccaagggtgctggtggggaaatctcaatgttctttttcgagtatgactgctttgttgatggcagattgctcatagagatgagagatggttgtgctggcttctttactgatgccgaacttgccgctggaaaaggtgtgctcaaaacgaaggctgagcttgctgcacgtgctcagatccagaaacaagacattgcaccctttgcacctgcaccgtgcagtcacaaaaccagcttggatgccagagaaatgagactgcttgttgataggcaatgggcaagggtctttggttctggaatggctggcatagactacaagttgtgtgcgagaaagatgctgatgattgacagagtcacacaccttgatccgcgtggaggtgctcacggtcttgggcttctcattggggagaaagtgcttgagagggaccactggtacttcccctgccactttgtgagggatgaggtcatggctggttctcttgtctcagatggatgctctcagcttctcaaggtttacatgttgtggcttggccttcacaccactgttggtgcgttcgactttcgtccagtcagtggtcatgccaacaaagtgaggtgtcgtggacagatttcaccgcacaaggggaaacttgtttatgtcatggagatcaaagaaatgggctttgatgccaaaactggagatccatttgccatagctgatgttgacatcattgatgtcaactttgaagagggacaagcgtttgctggagttgaggatcttcacagctatggccaaggagatttgaggaaaaagatagttgtggatttcaagggaattgcgttgtcactgcagaaaaggaaggagcaacagaaagagagcatgactgtcaccactacgaccacgacaaccagcagagtgattgctcctccaagtggatgcctcaaaggtgatcccactgctcccacctctgtcacgtggcatccaatggctgagggaaatggaggtcctggacccactccgtccttctctccttcagcgtatcctcccagagctgtttgcttctctcctttccccaacaatccgcttgacaatgatcatacacctggccaaatgccgttgacctggttcaacatgtctgagttcatgtgtggaaaagtgagcaactgcttgggtcctgagtttgccagatttgatgcttccaagacatccagatcaccagcttttgacctggctcttgtgacaagggtgacgagtgtggctgacatggaacatggtcctttctacaatgtggatgtcaaccctggccaaggcacgatggtgggtgagtttgattgtcctgcagatgcttggttctttggagcctcaagcagagacgatcacatgccgtacagcatcttgatggagattgctcttcagacttctggagtcctcacatctgtgctcaaagctccgctcacaatggacaaagatgacatccttttcagaaaccttgatgcagatgcagaacttgtgggtgatgccatgcctgatgtcagagggaaaaccataaggaacttcaccaaatgcacgggatactccatgcttggcaagatgggaatccatcgtttcaccttcgaactctctgttgacggagcagttttctacaaagggagcacctcttttggttggtttgttcctgaggtctttgagagccagactggattggacaatggcaagccgaggttgccttggtatagggaaaacaatgtggcagtggacacactctcagcacctgcgtcagcttctagtgcccaaggtcagcttcagcttcagaggagagggtcacaagcgcagttcctggacacaattcatcttgctgggagtggagctggagtgcatggccaaggttatgctcatggggagaaagctgtgaacaagcaagattggttcttttcttgccatttctggtttgacccagtgatgcctgggtctttgggaattgagtccatgttccagcttgtggaagcgtggtgtgtcaaacaaggcttggctgcaaggcatggaattgctcatccagtctttgcacatgcacctggtgccaccagctggaagtacagaggtcagttgaccccaaagaatgacagaatggacagtgaagttcacatcaagagtgttgctgccttctcctcatgggttgatgtggttgctgatgggttcctcttcgttgatggcctcagagtctattcagcagacaacctgagggtcagaatccagactggagctggccatgttgaagagcaagaagttgctgccaaagccaccacaaagaactccagcattgctgatgtggatgtggctgatcttcaagctctcaaacaagcgttgctgacactggagagaccattgcagttggatgctggaagtgaggtgccagcctgtgctgtcagcgatttgggagaccgtggattcatggagacttatggggtggttgctccgttgtacagtggtgcgatggccaagggaatagcctctgcggatctggtcatagcaatgggtcagaggaagatgttggggagctttggagctggtgggttgccaatgcacgttgtccgtgctgggattgaaaagatccaagctgcacttcccgctggtccgtatgctgtcaacctcatccactcaccgttcgatgccaacctggaaaagggcaatgttgatcttttcctggaaaagggagttcgtgtggttgaggcgtctgccttcatggaactcacaccacaagtggtccgttacagagccacgggactctccagagatgcgagaggtggctcagtgaggacagcacacaagatcataggaaaggtttccagaacagagcttgcggagatgttcatcagacctgcacctcaagcaattctggacaaacttgttgcgtctggtgaaatcacccctgagcaagctgcgttggctcttgaagttccaatggctgatgacattgcagttgaggctgacagtggagggcacactgacaaccgtcccattcatgtcattctgccgttgatcctcagtctgaggaataggctccagagggaactcaagtaccctgccagacaccgtgttagggttggtgctggtggaggcataggttgtcctcaagctgcacttggagccttccacatgggagctgcgtttgttgtgactggcactgtcaaccagctgtcccgtcaagctggaacatgtgacaacgtgaggcgtcagctctctcgtgccacttactctgacatcacgatggcaccagctgcagacatgtttgaacaaggagttgaactgcaagttctcaagaaaggaacgatgttcccatctcgtgccaagaaactctttgaactgttccacaagtatgattcctttgaagcaatgcctgcggatgaattggctcgtgttgagaagaggatcttctccaagtcccttgcagaagtttgggcagagaccaaagatttctacatcactcgtctcaacaatcctgaaaagatcagaaaggctgagaatgaggaccccaagctcaagatgtccctctgcttccgttggtacttgggtctcagctcattctgggcaaacaatggcatagctgaccgtacgatggattaccagatttggtgtggacctgccataggagccttcaacgatttcattgcagacagctatcttgatgttgcagtctctggtgagttccctgatgttgtgcagatcaaccttcaaatcctgtctggtgctgcgtatctccagagattgctcagtgtcaaacttgcaccaaggatagatgtggacactgaagatgacctcttcacctacagaccagatcatgcactctgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgacacaactttgtataataaagttgtctaggtcgatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtcgacctcgaggctagcactagtagcacatctgtactcactcaggtctagtggtcaggtcagattaattaagcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactacttatacgatgatgtattctacgtcgtcgtcctgttgttgttgctgcacgcggcggtagtgcgaggctccgaggaggatgtgctggttgatgtccacgacgcgcggaaactcgccggtgccagcggtcgcgtccagcttggtgccgcgaacgaagtcgttgaagctgccgatggcggggccgcaccagatctggtagtccgccttgcgcgcggacgtcgcctcggtagcccatcgcgacgactgcgacatgtaccagcgcacacagagcgccatcctctcctgcggacttgcagcggtagcgtcgacaccaaacttttcgcgtgcagcagcccacacgtccgccacggactgcttgaacacggagcgctcgagcttgcgcagctgcggctccggcacggcgtcaaaggagccgaacttggcctgcagctgggcgagcatcgtggcccgcgcggcgaacatggtctgcttcttgagcacctggacgccgcccggcgccatggccacgtccgagtaggtggccgtcgccagcagtagtcggaccgcgtcgctggtgccagcctcgcgggccagttggttgacggacccggtgaccacaaaggcggcgcccagggaaaaggcgagcagcgcggcgcgcggacaggcgatcccgccgccggcgccgacgcgcactggcgtgtccaccaggtggcgccagcggttgcgctgcgccaccacgagcggcagcagcacgtggatcggtcggttgtcggtgtgcccgcccgagtcggcctccaccgcgacgtcgtcggccatggcgacgcggctggccagcgcggcctgctcgggcgtaatctgtttggcggcgaccaaagcctctagtacggcggccggcgccgggcgcagaaagtgctcggccacctcggtgcgcgacaccttggcgaccacacggtgagtcgccgacacagaagcaccgcaactagttcgtcgcagacccgtgacacggtagcgcaccaggtctgcagagagcgcgccggtgtagcccgatgcctcgacgattgagacgcccgtgcgcagcagcgcgtccaccgtcgcggcctcgtcaggacccggcatcaggttgacagcaaaggcgttggaggtgcgttgctggatctcacggatctggagttccacctggtccataggcaagcgggccgctccgaatgatgccagcatgcgggcctcggcggcagcgaccaccaggtctaccgacgagatgccttccgccatggcgcccatgtagagcggccagtccacgtcgtagcagcgcagaaaggcgtcatccccaaccaacaacgacgacgacgtctgcttggccttgaccacgggcgtcgaatcagcaaccacagcaccagcagcagcaaccacaactgccttggctgggtgcaaacgaaccatgcaatgcgtcgagggtttggcacttgcagcagcaacctgcttgctgatgccgtcggggcaaaagtacccgttgacctctacgctgcgaaggaagcggttgggcttgggcgggggctcctgcatcgcagagtcgatagccgtcaggaacgtggggtggtacaggtccgcaaacagagtcgggttgtgcaggggcacgcggtgggcggtcagcagcgccagcgacttgagggtctgcgtccacgccgactcactggggcggtccagcgccacggagacatgcggggtggcagccttgccaagaatgtcactgaccgcggcggagcgcatgttgttcggccccacctcgacgaagacatcgtggccgtcacggctgaccttgtcgacgatgcccggaaagtcggcgatgcgcgtgtacaacttctgcacgaactcggtgatgctgctgttgctgcccccgcgcagctcggcgttggtgaccgaggtgtacatcttgacggggctgtccggaatctccaaaatctcgtggatgtgcgcgatgcccggcgtgtagggcgccacttcggggcagtgcccaatcatgccttgcttgacgggcatcggcggcaaccgcccgcccaggcgctccagcacgcgcagacactcggcaggtttgccggcgatcagcgcgctgctcgagtcgttgacgatcagcaggcgcacgaagcggttgtcgggcccgatcgccttctcgatttcggcgcggctggcgcgaaccaagtagccctgccagaaggactccacgggggcgtccgccggcacgttccatagcttgcgcaaggcctggaactccaccgccagctgtgtcgaccacaccggcgaggtgcgtaggcgctgcgtgagctggtccgacaggccgcagttgcgtcgcgacagcgcaaagagcatggagatctcgccgaggctgaggccgaagcacgccttgggctgcaccccgagcacgtcgcgcgcgtagtcggtgaggcagatggacacgaagatgcccgtgcggaacatctcgatctggtccgcgtcaaaggccgtctgcacggcgcgctgcgagtcggcatccaccgcgcgcggcatgagccacgagtcgccgttctcccacagcgccgcggtcttgtcgttgatgcgctcgtgcaaagccggccacaggcggtgcaggtcgagcccgacgccgtagtaggggctgcggccctcgccgtacatgaacgcgacgcggtcgctggtcacaggtgtcggcgcaaaggcgctgcccgatggcgacatccagttgcgcccggccttggcgcttcgcggtacacccttggctgccagctccaactccttctccagcttctccggcgttgtcagcagggccaaacacaaggtcgccgtggcaccgtgactagccaccgtctcccctacgagccgcaaaaagcgcaagcgatgagcagtgaaagcgacagcagcagctgggtcgtcgtcagtagcagacccggtttcggcgtgcgctcggaggagcgccagctcggcgttgaccttggccatgatatcgtcaacggtgtcgccacggatcgcgatgagcttgggggcggcgtcatccagcgagaggcggttgctgctctcatgagtggcgtactcgtctgtgaggagcacgccaaagcaggacccgctctcggaggcactggcgacagccgccagtcgcgactcgcccgggttcttcagccaggcacgcgagcgcgggcaagtaaacagcgcctcggagaccggcgccaccggccgctcccactgcgggttggccgggaggtagcggttgtggaggcacagcgccgtcttgatgaggctcgcggcgcccgaggcgtacccgacgtctcccacgttggcgcgcacgctgccgatggccaccgagcccggcacctggtgcgcgagcaacttggacacttgctccagctgcgactcggcgctcagcggcgagttggccaagtgcggcgcatggcgacccgagtcggcggcgagctccaccatctccaccaccctcttctcgttgtcgtcgttgtggacttggagtagtagcggcgacacggcttcagcgggctgcgcggcgcacgtgaggcccgcgacactggcgtagaccttgtcgtctgagccaacgtcggcctggcgcttgaggaccagggcgccgctgccctcgccggcaaagtacccgtcggcgctggcctcaaagttggcgcgagggtggtcctgtcggctgatggcggagcggcgcgccttgaggtaaaggttctcggcggtggcacagaggtcgacgccggccaccacgacggcgtccacctggtgcgtgtcgagcaggaacttgcccagctcgaggcagcggtagaccgagtttgcgccttcggtgacggtgaaggacgggcccgtaaagccccactgcgaggacacgcgcgtggccacgaggttgccgatgtacgacgtgtacgacgtcgaggtgccgcagtcgttgatgtagtccatcatctcctgcacctgctcgggcgagaacgcggccgggtcgagccgctccttgagtgtcacgcgcgcgcggtgccggtacagctcggtgtccgtgccgagccccaccagcaccgccaccttgcctcccgtcgccattccagcgtcctgcagcgcgcggtccatcgtagccaccgccagcagctgttgcgggcgcaggacgtcctcagggatcatcggcgaccgcagccgcttgtagtccacgtccacgtcgcgcacgtagcacccgcgcggcacggcgtcgaggcccatggcggtcaagaagtccgtgtcggcgcccaggaaccgccagcgcttgctcggcaggtcgctggcgccgtccgtgcccttgtagatggcctgctcaaacgcgtccaggcccttgagggtaccaaacgtcgcgtccatcccgatgatggcaatcggtccaggagtcacctcgggaagcaccggcgaggctgtcgcagtagcagcaatttggcggtgctcacggaagacacagtgcgcgttggttccaccaaagccaaaggcggagagcgaggcgcacttgagctcatcgcctggtttgcctgcccgcgcctgcgccgacgagtacggccaagggatggcctcgtccacgacgagcgggtcgatgcagttggagcggtcgacaccgggcgtgggcgggatcgtgccgtgctgcatcgacagcagcaccttggccatgcctgcgaacccggccgccacgagagtgtggccaaagttgcccttggtggagcccatgcgcggcgggtggtccgtgttacctcgaaagcagtggcgcagcgcctctacctccacgacgtcgccctgcggagtgcccgtggcgtggcactccacgtactgcacctcgcttgggtcgatgccgacgctcgtgtacaggtcctccatgcacgacttctcgctcggcaggtgcgggctcagcggcaggccgcacccggcgttgctcagactcgtgccgagcaaggtgccgtagatgcggtcgccgtcgcgcacggcgtcctcgaggcgcttcagcaccatgatggcgccgccctctccgggcgtcaggccctggctgccctgccgcagcggcacggacagtgggttatcgtccggtccgcccagcggcatcgcctggaaggtggagaaccccgagagaatgaagaacgggtccggaaagcatgtggcgccgcacagcatcacgtccgcgctgcgcgagagcaagtggtcggacgccagcttgaggcagtacagcgccgacgcgcaggctgcatcgaggctgtagcgcacgggccccaggccgagctggttggccacgaaggacgccgggtcggagtacacgcgcgggtcgctggcctcgggcgagacagcgcgcgggcgctccgaccaggggcgcgagtcgcggaagcgctgggcgcccacgcggttctccacatgcacttggtacagattgagcagctcgccctgcagattgtccatggggaacgacaggcagccgctcacgatgccgaagtcgcgtaggttggcggtggtgctggcgtcgtcgaggttaattccggcgtcgagcagggcgcgccgggccaggtcggcgaggaggtcgtgctcgttgtcgacgctggcatcgacgcagccgtagcgatcgttgcagaaggtgtcggcgtacttgctgcgctgcgggtggaagtggaggtcgcggtagcgcgtaccgaggcgctccgccgagatcgggctcgagttgatctccttacgcatcagcgtatcccagaactcgtcctggttcttgcatccggcatactgcaccgccatgcccacgaccgcaatgttatcgcacggcatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcccaactcactgactcgaacttgactggatgagttgctgagcctaggtctagatcgacacccagcttt

SEQ ID NO: 30 - DNA, 36595 bp, Artificial Sequence
  Plasmid pDAB112285
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggataccagaattgccattgtgggaatgagtgcgatccttccgagtggtgagaatgttagagagagctgggaggccatcagagatggcttggattgtctgtctgatctgcctgcggatcgtgtggatgtgactgcctattacaatccagagaaaacgaccaaggacaaaatctactgcaaaagaggtgggttcatccctgagtatgactttgatgctcgtgagtttggcctcaacatgttccagatggaagattctgatgcgaaccagaccatctcattgctcaaggtgaaggaagctctcaccgatgccaacatacctgctttctcaagtggcaaaaagaacattggttgtgttcttggcataggtggaggtcagaaggcgtcacatgagttctactccagactcaactatgttgtggttgacaaagtgctcagaaagatgggtttgccagaggaagatgtggcagctgcggtggacaagtacaaggcgagcttcccagagtggaggcttgattcttttcctggtttcttgggcaatgttaccgctggcagatgttgcaacaccttcaacatggagggcatgaactgtgtcgttgacgctgcctgtgcttcaagcctgattgcggtcaaggtggcaatagaagagcttctctatggtgactgtgatgccatgattgctggtgccacctgcacagacaattcaatagggatgtacatggccttctccaagacgcctgttttctctacggacccgagtgtcaaagcgtatgatgctgccaccaaaggcatgttgattggtgaaggatctgcgatgcttgttctgaagagatatgcggatgctgtcagagatggtgacactgttcatgctgtcatcaagggctgtgcttcctcaagtgatggaaaagcagctggaatctacacaccgacaatcagcggacaagaagaggctctccgtagagcctatgcacgtgccaatgtggacccagccactgtcactcttgttgaaggacatggaactggcactccggttggggacaagattgaactcacagctctgagcaatctcttctccaaagcgttttctgcgaatggaggtggagctgaggaagctgagcaagttgctgttggcagcatcaagagccagatagggcacctcaaagcggttgctggattggctggattggtcaaagtggtccttgctctcaagcacaagacattgcctcagacgatcaatgtggacaagccaccttcactggtggatgggacaccgattcaacagtcccctttgtacgtcaacaccatgaaccgtccctggttcactccggttggggttccgaggagagctggcgtttcctcatttggttttggaggtgcgaactaccatgctgtgcttgaagagtttgaacctgaacatgagagtgcttaccgttacaacaatcttccccaagttgctctccttcatgctggggatgttgcaactcttgctgccacagttagggcaaaactggcattggccactgctgagcaagaagaggctagagttgtgaagaacgctgattacattgcataccataggttccttgatgaatgtaagttgagaggagctgttccccaagcccacgcaagggttggacttctggtgagggacctgtcctctctcattgcggttttggaagcagctgcagccaaacttgctggagaagagtcagcaacggaatggacggtctcagttgccactggtgaggctgcattcagagttaggggtgttgccacagaggccaatgttgctgcacttttctctggccaaggagcgcagtacactcacatgttctcagatgttgccatgaactggcctccgttcagagagagtgttgctgcgatggacagagcgcagagagaacgttttgggaggccagccaaaagagtctccagtgttctctatccgagaaaaccttatggagatgagccaaggcaagatcacaaagagatttctcagacgcgttactctcagccagcaaccctcgcttgctctgtcggtgcctttgacatcttcaaagcagctggattggctccttcttttgcagctggacattccctgggagagtttgcagctctctatgcagctggttcattggatcgtgatgctgtgtttgacttggtttgcgctagggcaaaggccatgtctgatttcactgctcaagccagctccagtggaggtgctatggcagcggtcataggagccaaggctgatcagctcagccttggtggagcacctgatgtttggctggccaatagcaacagtccatcacagacggtgatcacgggaactgctgaagcagtggcagctgcatctgacaaacttcgttgtagtggaaacttcagagtggttcctcttgcttgtgaagctgccttccattcaccacacatgcgtggagcagagcagacatttgcgtctgcgcttgctcaagctccagtgtccgcacctgcagctgccagattctacagcaacgtcactggtggagctgcagtcacctctcctgctgatgtcaaaacgaaccttgggaaacacatgacttctcctgtgcagtttgtgcagcaagtccgtgccatgcacgcagctggagcaagggtgtttgttgagttcggtcccaagcaagtcctttctcgtttggtcaaagagacccttggggaagctggagacgtggtcacggtggctgtcaacccagactcagccaaggattcagacacccagctgagacaagcagctctcaccttggctgtggctggtgttccactcaaagactttgacagatggcagcttcccgatgccactcgtcttgagcctgtcaagaaaaagaaaacaaccttgaggttgagtgctgccacctatgtctctgccaagaccttgaggcagagggaggctgtgctcaatgatggttacactgtgagtggtgccacagcggttgtcaaagaagtggacactgcaaacgaagagagacttgtcagacaagcacaagacctccagcgtcagcttgctgaagcaagcactgcagcccaagcagctcaatccaaggtcgctgaattggagaggacaatccaagacttggagaggaaggttcaacagcaacagcaagagaaaggtgagaactctgactccaatgcagctgcggaagtgcttaggagacacaaggaactgctccagaggatgctccaagattgtgatgagcaagcagttcccgtggcaacagtcgttccaacacccacttcttcccctacaccaacatcctcaccagttagcggaaacagcaagtccaccagaggatcagccgacctccaagcactcctggcgaaagctgagacggtcgtgatggcagttttggctgcaaagactggctacgaggcagacatggtggaagcagatatggatttggaggctgagcttgggattgattccatcaaaagggtggagatcctgagtgaagtccaagggcagctcggagttgaagcgaaggatgttgatgccctttcacgtacaaggaccgtcggagaggttgtggatgccatgaaggctgagattgttgctgcatctggtgggtcagcacctgctgtcccctctgcaccagctgcatcagcggctccgacacctgctgcgagtaccgctccgagtgctgatcttcaggctctcctgtctaaagccgagacggttgtgatggctgtgctcgcagcgaaaactggttacgaggctgacatggtggaagctgacatggaccttgaagcggagttgggaatagatagcatcaaacgtgttgaaatcttgtctgaggtccaaggacagttgggtgtggaagccaaagatgtcgatgcgctttcaagaaccagaaccgtcggtgaggtcgtggacgccatgaaggctgagattgtggctgcctctgctggctccgctcctgctccagcagttccttctgcacctgcagcgtcagcggctccaactccagctgcatccacggctccttctgcagacctccaagccttgctgtccaaagccgaaacagttgtgatggctgtccttgctgcaaagactggttacgaagccgacatggttgaagctgacatggatttggaagccgaacttggaatagattccatcaaaagagtggagatactctctgaggtgcaaggtcagctcggagttgaagcgaaagacgttgatgccctcagtaggaccagaactgttggggaagttgtcgatgcgatgaaggctgagattgtcgctgccagcggtggatctgcacctgcacctgcggtcccgtcagctccagcagccagcgcagctccgactcctgcagctgccacagcaccgagtgcggatctgcaggcattgcttgcgaaggctgaaacagttgtcatggctgtcctggctgcgaaaactggctatgaggctgatatggtggaagccgacatggaccttgaggctgaattgggcattgacagcatcaagcgtgttgagattctcagtgaagtccaaggacagctcggagtggaggcgaaggatgtggatgccctctcaaggaccagaacagttggtgaggtcgttgatgcgatgaaggcagagattgttgctgccagtgctggttctgctcccgcacccgctgtcccaagcgcaccagctgcctccgccgctcccacaccagctgcctctactgcaccaagtgcggaccttcaagctctcctgagcaaggctgagacagttgtgatggcagtccttgctgcgaaaactggctatgaggcagacatggtggaagcggacatggatctggaagctgaacttggaattgactccatcaaacgtgttgaaatcctctctgaggttcaaggtcagcttggggtggaggccaaagatgttgatgctctttccagaacaaggacggtgggagaggtggttgatgccatgaaggctgagatagtggcagcgtcaggagggtcagcacctgcagctgccgttccgtccgcaccagcagcctctgcagctcccacgccagccaccgctcctagtgctgatttgcaagccctcctttcaaaagctgaaactgttgtcatggctgttttggctgccaagactggctacgaggctgacatggttgaggctgacatggacttggaagccgagcttgggattgatagcatcaagcgtgtggaaatcctttctgaggttcaaggtcagctgggtgttgaggccaaagatgtcgatgcgttgtcaaggaccagaacggttggagaagtggtcgatgccatgaaggctgagatagttgctgcctctggaggttcagctcctgcagctccgtcagcacctgccctccttccaactttgtttggttctgagtgtgaagatttgagcttgactttcccagtcatcacaaccctgcctcttcctgctgaacttgtgctggctgaaggtggagcacgtcctgtggttgtggttgacgatggctctgcactcaccagttctcttgtgtcctcacttggtgatcgtgctgtgctcttgcaagttcagtccagctctgcctgttcacccagaagcaccacgcacaagttggtcactgttgcagaccgttctgaagctgcattgcaagctgcgctcacatcagttgaagcacagtttggaaaagtgggaggttttgtgttccagtttggtgatgacgatgtccaagcgcagcttggttgggcactgcttgctgccaaacatctcaaaacgtccttgtcagaacagatagaaggtgggaggaccttctttgttgccgttgcgaggttggatggtcagttggggttgtctggaaagtccacgactgccactgttgatctctccagagcgcagcaaggctcagtctttggactctgcaaaacccttgacttggaatggcctgctgttttctgcagaggaatcgaccttgcagctgacttggatgctgcacaagctgccagatgtcttttgggtgagctttcagacccagatgtggcagtgagggagtctggttactccgcatctgggcaaagatgcaccacaaccacaaagtctctcaccacgggaaaaccacatcaaccgatctcttccagtgatttgttcctggtctctggaggtgctcgtggaatcacacctctttgtgtgagagaattggcacagagggtgggaggtggaacctatgtcctcattgggagaagtgagctgcccaccacggaacctgcctgggctgttggtgttgagtcagggaaacctcttgagaaggctgcgctggcgttcctcaaagctgagtttgcagctggaaggggagcgaagccgacaccgatgctccacaagaaacttgttggagctgttgtgggagctagagaggtccgtgcgagcctggcagagataactgctcaaggtgccacagctgtctatgagtcctgtgatgtcagctctgcagccaaggttcgtgaaatggttgagagggttcaacagcaaggagggagaagggtcagcggtgtgtttcatgcaagtggtgttttgagagacaagttggttgagaacaagtcactggctgatttcagtgctgtgtatgacacaaaggttggtggactcatcaacctccttgcctgtgtggatcttgcacagcttaggcacctggtgctcttcagctcccttgctgggttccacggcaatgttggtcagagtgactatgcaatggccaatgaggctctcaacaagctggctgcacatctgtctgctgtgcatccccaactttgtgcgagatccatttgctttggtccgtgggatggagggatggtgacgcctgcactcaaggccaacttcatcagaatgggcattcagattatccctcgtcaaggtggagcacagacagttgcgaacatgcttgtcagctccagccctggtcagctccttgttgggaactggggagtgccacctgtggttccaagtgccactgagcacactgttttgcagactcttcgtcagagcgacaaccccttcttggattcacatgtcattcaagggagaagggttttgccgatgacactggctgtcggctacatggctcaccaagctcagagcatctacgctggacatcagctttgggcagttgaggatgcccagcttttcaaaggcatagccattgacaatggagctgatgttccggttagggttgagttgtcaaggagaaaggaggaacaagaggatgctggcaaggtcaaggtcaaggttcaagtgcttctcaaatctcaagtcaatggcaagtcagtccctgcttacaaggcgactgtcgtgctttcccctgctccacgtcccagtgtcatcacccgtgactttgatctcactcctgacccagcctgcaccgaacatgacctctatgatggcaagacgctcttccacggcaaagccttccaaggaatagaacaagttctttctgcgacgccaaaacagctcactgccaaatgcagaaaccttccactcacaccggagcagcgtggccagtttgtggtcaatctcagccagcaagacccattccaagctgacattgctttccaagccatgcttgtttgggctaggatgttgagacagtctgctgcgctgcccaataactgtgaaaggtttgatttctacaaaccgatggctcctggagcaacttactataccagtgtcaaactggcttcagcttcaccattggtggattctgtgtgcaaatgcactgttgccatgcacgatgagcaaggtgaagtgtacttctctgcgagagccagtgttgtcctcaacaagacactcacatactgatgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgacacaactttgtatacaaaagttgtctagacctaggctcagcaactcatccagtcaagttcgagtcagtgagttgggcggccgcgaattctgtccaacagtctcagggttaatgtctatgtatcttaaataatgttgtcggtattttgtaatctcatatagattttcactgtgcgacgcaaaaatattaaataaatattattattatctacgttttgattgagatatcatcaatattataataaaaatatccattaaacacgatttgatacaaatgacagtcaataatctgatttgaatatttattaattgtaacgaattacataaagatcgaatagaaaatactgcactgcaaatgaaaattaacacatactaataaatgcgtcaaatatctttgccaagatcaagcggagtgagggcctcatatccggtctcagttacaagcacggtatccccgaagcgcgctccaccaatgccctcgacatagatgccgggctcgacgctgaggacattgcctaccttgagcatggtctcagcgccggctttaagctcaatcccatcccaatctgaatatcctatcccgcgcccagtccggtgtaagaacgggtctgtccatccacctctgttgactacagccactgcagccgcatggacctcacgtgccagaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgacatcttcaaagaaaactcctgtttgggaaatgagcaaggaagagctgttggatggcaagacggttgtctttgactacaacgagctgttggagtttgcggagggtgatgttggtcaagtgtttggaccagagtttgacatcattgacaagtacagaaggcgtgtgaggcttccagccagagaatacttgcttgtttcaagagtgactctcatggatgccgaggtgaataacttcagagttggctccagaatggtcactgagtatgatgttccagtcaatggtgagttgtcagagggaggtgatgttccctgggcagttcttgttgaaagtgggcagtgtgacttgatgctcatctcctacatggggattgacttccagtgcaaaggggaccgtgtttacagattgctcaacacatctctcaccttctttggggttgcccatgaaggagaaacccttgtgtatgacatcagagtcactggtttcgccaagggtgctggtggggaaatctcaatgttctttttcgagtatgactgctttgttgatggcagattgctcatagagatgagagatggttgtgctggcttctttactgatgccgaacttgccgctggaaaaggtgtgctcaaaacgaaggctgagcttgctgcacgtgctcagatccagaaacaagacattgcaccctttgcacctgcaccgtgcagtcacaaaaccagcttggatgccagagaaatgagactgcttgttgataggcaatgggcaagggtctttggttctggaatggctggcatagactacaagttgtgtgcgagaaagatgctgatgattgacagagtcacacaccttgatccgcgtggaggtgctcacggtcttgggcttctcattggggagaaagtgcttgagagggaccactggtacttcccctgccactttgtgagggatgaggtcatggctggttctcttgtctcagatggatgctctcagcttctcaaggtttacatgttgtggcttggccttcacaccactgttggtgcgttcgactttcgtccagtcagtggtcatgccaacaaagtgaggtgtcgtggacagatttcaccgcacaaggggaaacttgtttatgtcatggagatcaaagaaatgggctttgatgccaaaactggagatccatttgccatagctgatgttgacatcattgatgtcaactttgaagagggacaagcgtttgctggagttgaggatcttcacagctatggccaaggagatttgaggaaaaagatagttgtggatttcaagggaattgcgttgtcactgcagaaaaggaaggagcaacagaaagagagcatgactgtcaccactacgaccacgacaaccagcagagtgattgctcctccaagtggatgcctcaaaggtgatcccactgctcccacctctgtcacgtggcatccaatggctgagggaaatggaggtcctggacccactccgtccttctctccttcagcgtatcctcccagagctgtttgcttctctcctttccccaacaatccgcttgacaatgatcatacacctggccaaatgccgttgacctggttcaacatgtctgagttcatgtgtggaaaagtgagcaactgcttgggtcctgagtttgccagatttgatgcttccaagacatccagatcaccagcttttgacctggctcttgtgacaagggtgacgagtgtggctgacatggaacatggtcctttctacaatgtggatgtcaaccctggccaaggcacgatggtgggtgagtttgattgtcctgcagatgcttggttctttggagcctcaagcagagacgatcacatgccgtacagcatcttgatggagattgctcttcagacttctggagtcctcacatctgtgctcaaagctccgctcacaatggacaaagatgacatccttttcagaaaccttgatgcagatgcagaacttgtgggtgatgccatgcctgatgtcagagggaaaaccataaggaacttcaccaaatgcacgggatactccatgcttggcaagatgggaatccatcgtttcaccttcgaactctctgttgacggagcagttttctacaaagggagcacctcttttggttggtttgttcctgaggtctttgagagccagactggattggacaatggcaagccgaggttgccttggtatagggaaaacaatgtggcagtggacacactctcagcacctgcgtcagcttctagtgcccaaggtcagcttcagcttcagaggagagggtcacaagcgcagttcctggacacaattcatcttgctgggagtggagctggagtgcatggccaaggttatgctcatggggagaaagctgtgaacaagcaagattggttcttttcttgccatttctggtttgacccagtgatgcctgggtctttgggaattgagtccatgttccagcttgtggaagcgtggtgtgtcaaacaaggcttggctgcaaggcatggaattgctcatccagtctttgcacatgcacctggtgccaccagctggaagtacagaggtcagttgaccccaaagaatgacagaatggacagtgaagttcacatcaagagtgttgctgccttctcctcatgggttgatgtggttgctgatgggttcctcttcgttgatggcctcagagtctattcagcagacaacctgagggtcagaatccagactggagctggccatgttgaagagcaagaagttgctgccaaagccaccacaaagaactccagcattgctgatgtggatgtggctgatcttcaagctctcaaacaagcgttgctgacactggagagaccattgcagttggatgctggaagtgaggtgccagcctgtgctgtcagcgatttgggagaccgtggattcatggagacttatggggtggttgctccgttgtacagtggtgcgatggccaagggaatagcctctgcggatctggtcatagcaatgggtcagaggaagatgttggggagctttggagctggtgggttgccaatgcacgttgtccgtgctgggattgaaaagatccaagctgcacttcccgctggtccgtatgctgtcaacctcatccactcaccgttcgatgccaacctggaaaagggcaatgttgatcttttcctggaaaagggagttcgtgtggttgaggcgtctgccttcatggaactcacaccacaagtggtccgttacagagccacgggactctccagagatgcgagaggtggctcagtgaggacagcacacaagatcataggaaaggtttccagaacagagcttgcggagatgttcatcagacctgcacctcaagcaattctggacaaacttgttgcgtctggtgaaatcacccctgagcaagctgcgttggctcttgaagttccaatggctgatgacattgcagttgaggctgacagtggagggcacactgacaaccgtcccattcatgtcattctgccgttgatcctcagtctgaggaataggctccagagggaactcaagtaccctgccagacaccgtgttagggttggtgctggtggaggcataggttgtcctcaagctgcacttggagccttccacatgggagctgcgtttgttgtgactggcactgtcaaccagctgtcccgtcaagctggaacatgtgacaacgtgaggcgtcagctctctcgtgccacttactctgacatcacgatggcaccagctgcagacatgtttgaacaaggagttgaactgcaagttctcaagaaaggaacgatgttcccatctcgtgccaagaaactctttgaactgttccacaagtatgattcctttgaagcaatgcctgcggatgaattggctcgtgttgagaagaggatcttctccaagtcccttgcagaagtttgggcagagaccaaagatttctacatcactcgtctcaacaatcctgaaaagatcagaaaggctgagaatgaggaccccaagctcaagatgtccctctgcttccgttggtacttgggtctcagctcattctgggcaaacaatggcatagctgaccgtacgatggattaccagatttggtgtggacctgccataggagccttcaacgatttcattgcagacagctatcttgatgttgcagtctctggtgagttccctgatgttgtgcagatcaaccttcaaatcctgtctggtgctgcgtatctccagagattgctcagtgtcaaacttgcaccaaggatagatgtggacactgaagatgacctcttcacctacagaccagatcatgcactctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctaggtcgatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtcgacctcgaggctagcactagttagatcagtccgtactcgtctacggcctcagtgacagtagttaattaagcggccgcgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactacttatacgatgatgtattctacgtcgtcgtcctgttgttgttgctgcacgcggcggtagtgcgaggctccgaggaggatgtgctggttgatgtccacgacgcgcggaaactcgccggtgccagcggtcgcgtccagcttggtgccgcgaacgaagtcgttgaagctgccgatggcggggccgcaccagatctggtagtccgccttgcgcgcggacgtcgcctcggtagcccatcgcgacgactgcgacatgtaccagcgcacacagagcgccatcctctcctgcggacttgcagcggtagcgtcgacaccaaacttttcgcgtgcagcagcccacacgtccgccacggactgcttgaacacggagcgctcgagcttgcgcagctgcggctccggcacggcgtcaaaggagccgaacttggcctgcagctgggcgagcatcgtggcccgcgcggcgaacatggtctgcttcttgagcacctggacgccgcccggcgccatggccacgtccgagtaggtggccgtcgccagcagtagtcggaccgcgtcgctggtgccagcctcgcgggccagttggttgacggacccggtgaccacaaaggcggcgcccagggaaaaggcgagcagcgcggcgcgcggacaggcgatcccgccgccggcgccgacgcgcactggcgtgtccaccaggtggcgccagcggttgcgctgcgccaccacgagcggcagcagcacgtggatcggtcggttgtcggtgtgcccgcccgagtcggcctccaccgcgacgtcgtcggccatggcgacgcggctggccagcgcggcctgctcgggcgtaatctgtttggcggcgaccaaagcctctagtacggcggccggcgccgggcgcagaaagtgctcggccacctcggtgcgcgacaccttggcgaccacacggtgagtcgccgacacagaagcaccgcaactagttcgtcgcagacccgtgacacggtagcgcaccaggtctgcagagagcgcgccggtgtagcccgatgcctcgacgattgagacgcccgtgcgcagcagcgcgtccaccgtcgcggcctcgtcaggacccggcatcaggttgacagcaaaggcgttggaggtgcgttgctggatctcacggatctggagttccacctggtccataggcaagcgggccgctccgaatgatgccagcatgcgggcctcggcggcagcgaccaccaggtctaccgacgagatgccttccgccatggcgcccatgtagagcggccagtccacgtcgtagcagcgcagaaaggcgtcatccccaaccaacaacgacgacgacgtctgcttggccttgaccacgggcgtcgaatcagcaaccacagcaccagcagcagcaaccacaactgccttggctgggtgcaaacgaaccatgcaatgcgtcgagggtttggcacttgcagcagcaacctgcttgctgatgccgtcggggcaaaagtacccgttgacctctacgctgcgaaggaagcggttgggcttgggcgggggctcctgcatcgcagagtcgatagccgtcaggaacgtggggtggtacaggtccgcaaacagagtcgggttgtgcaggggcacgcggtgggcggtcagcagcgccagcgacttgagggtctgcgtccacgccgactcactggggcggtccagcgccacggagacatgcggggtggcagccttgccaagaatgtcactgaccgcggcggagcgcatgttgttcggccccacctcgacgaagacatcgtggccgtcacggctgaccttgtcgacgatgcccggaaagtcggcgatgcgcgtgtacaacttctgcacgaactcggtgatgctgctgttgctgcccccgcgcagctcggcgttggtgaccgaggtgtacatcttgacggggctgtccggaatctccaaaatctcgtggatgtgcgcgatgcccggcgtgtagggcgccacttcggggcagtgcccaatcatgccttgcttgacgggcatcggcggcaaccgcccgcccaggcgctccagcacgcgcagacactcggcaggtttgccggcgatcagcgcgctgctcgagtcgttgacgatcagcaggcgcacgaagcggttgtcgggcccgatcgccttctcgatttcggcgcggctggcgcgaaccaagtagccctgccagaaggactccacgggggcgtccgccggcacgttccatagcttgcgcaaggcctggaactccaccgccagctgtgtcgaccacaccggcgaggtgcgtaggcgctgcgtgagctggtccgacaggccgcagttgcgtcgcgacagcgcaaagagcatggagatctcgccgaggctgaggccgaagcacgccttgggctgcaccccgagcacgtcgcgcgcgtagtcggtgaggcagatggacacgaagatgcccgtgcggaacatctcgatctggtccgcgtcaaaggccgtctgcacggcgcgctgcgagtcggcatccaccgcgcgcggcatgagccacgagtcgccgttctcccacagcgccgcggtcttgtcgttgatgcgctcgtgcaaagccggccacaggcggtgcaggtcgagcccgacgccgtagtaggggctgcggccctcgccgtacatgaacgcgacgcggtcgctggtcacaggtgtcggcgcaaaggcgctgcccgatggcgacatccagttgcgcccggccttggcgcttcgcggtacacccttggctgccagctccaactccttctccagcttctccggcgttgtcagcagggccaaacacaaggtcgccgtggcaccgtgactagccaccgtctcccctacgagccgcaaaaagcgcaagcgatgagcagtgaaagcgacagcagcagctgggtcgtcgtcagtagcagacccggtttcggcgtgcgctcggaggagcgccagctcggcgttgaccttggccatgatatcgtcaacggtgtcgccacggatcgcgatgagcttgggggcggcgtcatccagcgagaggcggttgctgctctcatgagtggcgtactcgtctgtgaggagcacgccaaagcaggacccgctctcggaggcactggcgacagccgccagtcgcgactcgcccgggttcttcagccaggcacgcgagcgcgggcaagtaaacagcgcctcggagaccggcgccaccggccgctcccactgcgggttggccgggaggtagcggttgtggaggcacagcgccgtcttgatgaggctcgcggcgcccgaggcgtacccgacgtctcccacgttggcgcgcacgctgccgatggccaccgagcccggcacctggtgcgcgagcaacttggacacttgctccagctgcgactcggcgctcagcggcgagttggccaagtgcggcgcatggcgacccgagtcggcggcgagctccaccatctccaccaccctcttctcgttgtcgtcgttgtggacttggagtagtagcggcgacacggcttcagcgggctgcgcggcgcacgtgaggcccgcgacactggcgtagaccttgtcgtctgagccaacgtcggcctggcgcttgaggaccagggcgccgctgccctcgccggcaaagtacccgtcggcgctggcctcaaagttggcgcgagggtggtcctgtcggctgatggcggagcggcgcgccttgaggtaaaggttctcggcggtggcacagaggtcgacgccggccaccacgacggcgtccacctggtgcgtgtcgagcaggaacttgcccagctcgaggcagcggtagaccgagtttgcgccttcggtgacggtgaaggacgggcccgtaaagccccactgcgaggacacgcgcgtggccacgaggttgccgatgtacgacgtgtacgacgtcgaggtgccgcagtcgttgatgtagtccatcatctcctgcacctgctcgggcgagaacgcggccgggtcgagccgctccttgagtgtcacgcgcgcgcggtgccggtacagctcggtgtccgtgccgagccccaccagcaccgccaccttgcctcccgtcgccattccagcgtcctgcagcgcgcggtccatcgtagccaccgccagcagctgttgcgggcgcaggacgtcctcagggatcatcggcgaccgcagccgcttgtagtccacgtccacgtcgcgcacgtagcacccgcgcggcacggcgtcgaggcccatggcggtcaagaagtccgtgtcggcgcccaggaaccgccagcgcttgctcggcaggtcgctggcgccgtccgtgcccttgtagatggcctgctcaaacgcgtccaggcccttgagggtaccaaacgtcgcgtccatcccgatgatggcaatcggtccaggagtcacctcgggaagcaccggcgaggctgtcgcagtagcagcaatttggcggtgctcacggaagacacagtgcgcgttggttccaccaaagccaaaggcggagagcgaggcgcacttgagctcatcgcctggtttgcctgcccgcgcctgcgccgacgagtacggccaagggatggcctcgtccacgacgagcgggtcgatgcagttggagcggtcgacaccgggcgtgggcgggatcgtgccgtgctgcatcgacagcagcaccttggccatgcctgcgaacccggccgccacgagagtgtggccaaagttgcccttggtggagcccatgcgcggcgggtggtccgtgttacctcgaaagcagtggcgcagcgcctctacctccacgacgtcgccctgcggagtgcccgtggcgtggcactccacgtactgcacctcgcttgggtcgatgccgacgctcgtgtacaggtcctccatgcacgacttctcgctcggcaggtgcgggctcagcggcaggccgcacccggcgttgctcagactcgtgccgagcaaggtgccgtagatgcggtcgccgtcgcgcacggcgtcctcgaggcgcttcagcaccatgatggcgccgccctctccgggcgtcaggccctggctgccctgccgcagcggcacggacagtgggttatcgtccggtccgcccagcggcatcgcctggaaggtggagaaccccgagagaatgaagaacgggtccggaaagcatgtggcgccgcacagcatcacgtccgcgctgcgcgagagcaagtggtcggacgccagcttgaggcagtacagcgccgacgcgcaggctgcatcgaggctgtagcgcacgggccccaggccgagctggttggccacgaaggacgccgggtcggagtacacgcgcgggtcgctggcctcgggcgagacagcgcgcgggcgctccgaccaggggcgcgagtcgcggaagcgctgggcgcccacgcggttctccacatgcacttggtacagattgagcagctcgccctgcagattgtccatggggaacgacaggcagccgctcacgatgccgaagtcgcgtaggttggcggtggtgctggcgtcgtcgaggttaattccggcgtcgagcagggcgcgccgggccaggtcggcgaggaggtcgtgctcgttgtcgacgctggcatcgacgcagccgtagcgatcgttgcagaaggtgtcggcgtacttgctgcgctgcgggtggaagtggaggtcgcggtagcgcgtaccgaggcgctccgccgagatcgggctcgagttgatctccttacgcatcagcgtatcccagaactcgtcctggttcttgcatccggcatactgcaccgccatgcccacgaccgcaatgttatcgcacggcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaggtctagatcgacacccagcttt

SEQ ID NO: 31 - DNA, 36880 bp, Artificial Sequence
  Plasmid pDAB117501
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggatactcgcatcgcgatcgtggggatgtcggcgatcctgccgagcggggagaacgtgcgcgagagctgggaggcgatccgcgatgggctggattgcctgagcgatctgccggcggaccgcgtggacgtgacggcctactacaacccggagaagacgaccaaggacaagatctactgcaagcgcggcgggttcatcccggagtacgacttcgacgcgcgtgagttcgggctcaacatgttccagatggaggactcggacgccaaccagacgatctcgctgctcaaggtgaaggaggcgctgacggacgccaacatcccggcgttctcgagcggtaagaagaacatcggctgcgtgctgggcatcggcggcggccagaaggcgagccacgagttctactcgcggctcaactacgtggtcgtggacaaggtgctgcgcaagatgggcctgccggaggaagacgtggcggcggcggtggacaagtacaaggcgagtttccccgagtggcgcctcgactctttccccgggttcctgggcaacgtcacggcggggcgctgctgcaataccttcaacatggagggcatgaactgcgtcgtggacgcggcctgcgcgtcgtcgctgatcgcggtcaaagtggcgatcgaggagctgctctacggcgactgcgatgcgatgatcgcgggtgccacctgcacggacaactcgatcgggatgtacatggccttctccaagacgcccgtgttttccacggacccgagcgtcaaggcgtacgacgccgccaccaaaggcatgctcatcggcgagggctcggcgatgctcgtgctgaagcgctacgcggacgccgtgcgcgacggcgacaccgtgcacgccgtcatcaaggggtgcgcgtcctcgagcgacggcaaggcggcgggcatctacacgccgacaatctcgggccaggaggaggccctgcgccgcgcctacgcccgcgccaatgtcgacccggccactgtgacgctggtggagggccacggcacgggtacgccggtgggcgacaagatcgagctgacggcgctgagcaacctcttctccaaggcgttttctgccaacggtggcggcgcggaggaagcagagcaggtggcggtgggcagcatcaagtcgcagatcgggcacctcaaggcggtggccgggctggccgggctggtcaaggtggtgctggcgctcaagcacaagacgctgccgcagacgatcaacgtcgacaagccgccgtcgctggtggacgggaccccgatccagcagtcgccgctgtacgtcaacacgatgaaccgcccctggttcacgcccgtaggggtgccgcgccgcgccggcgtgtcgtcgtttgggtttggcggtgccaactaccacgccgtgctggaggagtttgagcccgagcacgagagcgcgtaccggtacaacaacctgccgcaggtggcgctgctgcacgcgggggacgtcgcgaccttggcggcgacggttcgcgccaagctggcgctggccaccgccgagcaggaagaggcgcgtgtggtgaagaacgcggactacatcgcgtaccaccggttcctggacgagtgcaagttgcgcggcgctgtgccgcaggcgcacgcgcgggtgggactgctcgtacgggacctgagctcgctcatcgccgtgctcgaggccgctgccgccaagctcgcgggcgaagagagcgcgacggagtggacggtcagcgttgctacgggcgaggcggccttccgcgtgcgcggtgtggctacggaggccaacgtggcggcgctgttctcgggccagggcgcgcagtacacgcacatgttcagcgacgtggcgatgaactggcccccgttccgcgagagcgtcgccgccatggaccgcgcccagcgcgagcgcttcgggcggcctgccaagcgcgtgagcagcgtgctgtacccgcgcaagccgtacggcgacgaaccgcggcaggaccacaaggagatctcgcaaacgcgctactcgcagcccgcaacgctcgcgtgctcggtcggcgcctttgacatcttcaaagcggcgggactggcgccgagctttgcggcgggccactcgctgggcgagtttgcggcgctctacgcggccgggtcgctcgatcgcgacgccgtcttcgacctggtctgcgcgcgcgccaaggccatgagcgacttcacggcccaggccagcagcagcggtggcgccatggcggccgtgattggcgccaaggcggaccagctctcgctgggtggcgcgcccgacgtgtggctcgccaacagcaactcgccctcgcagaccgtgatcacgggaaccgccgaagcagtggctgcggcctctgacaagttgcgctgcagcggcaacttccgcgtcgtgcctctggcctgcgaggcggccttccactcgccgcacatgcgcggcgcggagcagacgtttgcgtcggcgctcgcgcaggcgcccgtgtcggcaccggcggctgctcggttctactctaacgtgacggggggcgccgcggtaacctcgcccgcggacgtcaaaacgaacctgggcaagcacatgacgagccctgtgcagttcgtgcagcaggtgcgagccatgcacgcggcgggcgcgcgtgtgtttgtggagtttgggcccaagcaggtcctgtcgcgcctcgtcaaggagacccttggcgaggccggcgacgtggtcacggtcgccgtcaacccagactcggccaaggacagcgacacgcagctgcgccaggcggcgctcacgttggcggtcgccggcgtgccgctcaaggactttgaccgctggcagctgccggatgccacgcgcctcgagcctgtcaagaagaagaagaccacgttgcggctctcggcagccacctacgtctccgccaagacgttgcgccagcgcgaggccgtgctcaacgacggctacactgtcagtggtgccacggcggtagtcaaggaagtggacacggccaacgaggagcgtctcgtccgccaagcccaggatctccagcgccagctcgcggaggcctcgacggcagcccaggcggcgcagtccaaggtcgcggagctcgagcgcacgatccaggacttggagcgcaaggtgcagcagcagcagcaagagaagggtgagaactcagacagcaacgctgccgccgaagtgctgcggcgccacaaggagctgctccagcgcatgctgcaggactgtgacgagcaggcagtgcccgtagccacggtggttccgacacctacgtcctccccgacgcctacatcctcacccgtatccggcaacagcaagagcactcgtggcagtgctgatctgcaagcgctgctggccaaggcggagactgtggtgatggctgtgctggctgccaagactggctacgaggccgacatggttgaggcggacatggacctggaggccgagctcggcatcgactcgatcaagcgcgtggagatcctttccgaggtgcagggccagctgggcgtcgaggccaaggacgtggatgcgctgagccgcacgcgcacggtcggtgaggttgtggacgccatgaaggcggagatcgtggctgcctctggtggtagtgctcctgcggttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctgctggtagtgctcctgctcctgctgttccttcggcgcccgctgcttctgcagctccgactcccgctgcttcgactgcgccttctgctgatctgcaagcgctgctgtccaaggcggagacggtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctcctgcggttccttcggcgcccgctgcttctgcagctccgactcccgcggctgcgacagcgccttctgctgatctgcaagcgctgctggccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaggttgtggatgccatgaaggcggagatcgtggctgcctctgctggtagtgctcctgctcctgctgttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctgctgctgttccttcggcgcccgctgcttctgcagctccgactcctgcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaagtggtggacgccatgaaggcggagatcgtggctgcctctggtggtagtgctcctgctgctccttcggcgcccgcgcttcttccaacgctgtttggttccgagtgcgaggacctgtctctgacctttcccgtgataacgaccctgccgcttcctgcagagcttgtgctggccgagggcggcgctcgccctgtagtcgtggtggatgatggatctgcactcacctcgtcgctggtgtcctcgctcggcgatcgtgcggtgctgctgcaggtgcagtcttcctctgcctgctcgccgcgctcgaccacgcacaagttggtgaccgtagcagaccgctctgaagcggcgctacaggcggcgctcacgtccgtcgaggcgcagttcggcaaggtgggtggctttgtgttccagttcggcgacgacgacgtgcaagcgcagctcggctgggcgctgctcgcggccaagcacctcaaaacttcgctgtcagaacagatcgagggcggtcgcacctttttcgtggccgtcgcgcggctcgacggccagctggggctctccggcaagtcgacgaccgctaccgttgatctctcccgcgcgcagcagggcagcgtgttcggcctgtgcaagacactcgacctggagtggcccgctgtcttctgccgcggaatcgacctggccgccgacctcgacgccgcacaggccgcgcggtgcctgctgggcgagctgtcagaccccgacgtggccgtgcgcgagtctggttactccgcctcgggccagcgctgcacgacaactacgaagtcgctgactacgggcaagccgcaccagccgatctcctcgtcggacctctttctggtgtcgggcggcgcgcgcggcatcaccccgctgtgcgtgcgcgagctggcgcagcgcgtgggcggcggcacgtacgtgctcatcggccgctcggagctgcccacgacggagcctgcctgggcggtcggcgtggagtctggcaagccgctggagaaggccgcgctggcgttcctgaaggcggagtttgcagcgggccgcggggccaagccgacgccgatgctgcacaagaagctcgtgggcgccgtggtcggagcgcgcgaggtgcgagcctcgctcgccgagatcactgcacagggcgccacggctgtgtacgagtcgtgcgacgtgagctctgccgccaaggtgcgtgagatggtagagcgcgtgcagcagcagggcgggcggcgcgtgtcgggcgtgttccacgcgtcgggcgtgctgcgcgacaagctcgtggagaacaagtcgctggcggacttcagcgccgtgtacgacaccaaggtgggcggcctcatcaacctgctggcctgcgtggacctggcgcagctgcgtcacctcgtgctcttcagctcgctcgcgggcttccacggcaacgtcgggcagtcggactacgcaatggccaacgaggcgctcaacaagctggcggcgcacctgtcggcggtgcacccgcagctgtgcgcgcgctcgatctgcttcggaccgtgggacggcggcatggtgacccccgcgctcaaggccaacttcatccgcatgggcatccagatcatcccgcgccaaggcggcgcgcagaccgtcgccaacatgctcgtcagtagctcccccggtcagctgctcgtgggcaactggggcgtgccacccgtcgtgccgagtgccaccgagcacaccgtgctgcagacgctccgccagagcgacaaccccttcctcgactcgcacgtgatccagggccgccgcgtgctgcccatgaccctggccgtgggctacatggcgcaccaggcgcagagcatctacgcgggccaccagctgtgggccgtcgaggacgcccagctcttcaagggcatcgccatcgacaatggcgccgacgtgcccgtgcgcgtggagctgtcgcgccgcaaggaggagcaggaggacgccggcaaggtcaaggtcaaggtgcaggtgctgctcaaatcgcaggtcaacggcaagtcggtgcccgcgtacaaggcgaccgtcgtgctgtcccctgcgccgcgccccagcgtcatcacgcgtgacttcgacctcaccccggacccggcctgcacggagcacgacctctacgacggcaagacgctcttccacggcaaggccttccagggcatcgagcaggtgctctcggcgacgcccaagcagctcaccgccaagtgccgcaatttgcccctcacgcccgagcagcgcggccagttcgtcgttaacctcagccagcaggacccgttccaggcggacattgcgttccaggcgatgctcgtctgggcgcgcatgctgcgccaatcggcggccctgcccaacaactgcgagcgcttcgacttttacaagccgatggccccgggcgccacctactacacgtcggtcaagctggcctcggcctcacccttggtggactctgtgtgcaagtgcaccgtggcgatgcacgatgagcaaggtgaggtgtacttttctgctcgtgccagcgtcgtcctcaacaagaccctcacgtactaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcgaattctgtccaacagtctcagggttaatgtctatgtatcttaaataatgttgtcggtattttgtaatctcatatagattttcactgtgcgacgcaaaaatattaaataaatattattattatctacgttttgattgagatatcatcaatattataataaaaatatccattaaacacgatttgatacaaatgacagtcaataatctgatttgaatatttattaattgtaacgaattacataaagatcgaatagaaaatactgcactgcaaatgaaaattaacacatactaataaatgcgtcaaatatctttgccaagatcaagcggagtgagggcctcatatccggtctcagttacaagcacggtatccccgaagcgcgctccaccaatgccctcgacatagatgccgggctcgacgctgaggacattgcctaccttgagcatggtctcagcgccggctttaagctcaatcccatcccaatctgaatatcctatcccgcgcccagtccggtgtaagaacgggtctgtccatccacctctgttgactacagccactgcagccgcatggacctcacgtgccagaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaatctgacctgaccactagacctgagtgagtacagatgtgctactagtgctagcctcgaggtcgaccaacttttctatacaaagttgtctagacctagggcggccgcagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttggatccacaaccaaaaatgacatcatcgaagaagactcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaagtagttagcttaatcacttaggtcacccataagtatgtagtactaaaatgtatgctgtaatagctcatagtgagcgaggaaagtatcgggctatttaactatgacttgagctccatctatgaataaataaatcagcatatgatgcttttgttttgtgtacttcaactgtctgcttagctaatttgatatggttggcacttggcacgtataaatatgctgaagtaatttactctgaagctaaattaactagattagatgagtgtattatatacaaaaggcattaaatcagatacatcttagacaaattgtcacggtctaccagaaaagaaattgcatttgtttttgggtctttcagactgagcggccgcttaattaaactagtgctagcctcgaggtcgacacaactttgtataataaagttgtctaggtcgatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtcgacctcgaggctagcactagtttaattaagcggccgctaagtcaataacaaatcttaaaactgaactttattttttttattactgcttatcgttctttgcttctaaagagtcttcaccaaataaaagaacacttgcataatttagtgcatacaaaaatagtttcgaagtatctgatcaaaaccagatttgagtctttgttggatcccattggatgatcttttatcactagccttgaaggcttgattagacatctagaaaaagaaaatctgacatgttcaatagactagtactgcttcattgtgaatatagattaattgttttctttttggtgtatctgttgttaatcatcactttataggaaagtagcaagagtaaaaaaaaaaacttctcttttattaccgtctacggagtagttcttattacattagtacattatttatggaacacacaccatgactatgtagtgttaacatacatcaacaaccacactcatatcaccgtggtatacacactctcgaggatatttcgtttggaatggtgacctaagtgattaagctaactacttatacgatgatgtattctacgtcgtcgtcctgttgttgttgctgcacgcggcggtagtgcgaggctccgaggaggatgtgctggttgatgtccacgacgcgcggaaactcgccggtgccagcggtcgcgtccagcttggtgccgcgaacgaagtcgttgaagctgccgatggcggggccgcaccagatctggtagtccgccttgcgcgcggacgtcgcctcggtagcccatcgcgacgactgcgacatgtaccagcgcacacagagcgccatcctctcctgcggacttgcagcggtagcgtcgacaccaaacttttcgcgtgcagcagcccacacgtccgccacggactgcttgaacacggagcgctcgagcttgcgcagctgcggctccggcacggcgtcaaaggagccgaacttggcctgcagctgggcgagcatcgtggcccgcgcggcgaacatggtctgcttcttgagcacctggacgccgcccggcgccatggccacgtccgagtaggtggccgtcgccagcagtagtcggaccgcgtcgctggtgccagcctcgcgggccagttggttgacggacccggtgaccacaaaggcggcgcccagggaaaaggcgagcagcgcggcgcgcggacaggcgatcccgccgccggcgccgacgcgcactggcgtgtccaccaggtggcgccagcggttgcgctgcgccaccacgagcggcagcagcacgtggatcggtcggttgtcggtgtgcccgcccgagtcggcctccaccgcgacgtcgtcggccatggcgacgcggctggccagcgcggcctgctcgggcgtaatctgtttggcggcgaccaaagcctctagtacggcggccggcgccgggcgcagaaagtgctcggccacctcggtgcgcgacaccttggcgaccacacggtgagtcgccgacacagaagcaccgcaactagttcgtcgcagacccgtgacacggtagcgcaccaggtctgcagagagcgcgccggtgtagcccgatgcctcgacgattgagacgcccgtgcgcagcagcgcgtccaccgtcgcggcctcgtcaggacccggcatcaggttgacagcaaaggcgttggaggtgcgttgctggatctcacggatctggagttccacctggtccataggcaagcgggccgctccgaatgatgccagcatgcgggcctcggcggcagcgaccaccaggtctaccgacgagatgccttccgccatggcgcccatgtagagcggccagtccacgtcgtagcagcgcagaaaggcgtcatccccaaccaacaacgacgacgacgtctgcttggccttgaccacgggcgtcgaatcagcaaccacagcaccagcagcagcaaccacaactgccttggctgggtgcaaacgaaccatgcaatgcgtcgagggtttggcacttgcagcagcaacctgcttgctgatgccgtcggggcaaaagtacccgttgacctctacgctgcgaaggaagcggttgggcttgggcgggggctcctgcatcgcagagtcgatagccgtcaggaacgtggggtggtacaggtccgcaaacagagtcgggttgtgcaggggcacgcggtgggcggtcagcagcgccagcgacttgagggtctgcgtccacgccgactcactggggcggtccagcgccacggagacatgcggggtggcagccttgccaagaatgtcactgaccgcggcggagcgcatgttgttcggccccacctcgacgaagacatcgtggccgtcacggctgaccttgtcgacgatgcccggaaagtcggcgatgcgcgtgtacaacttctgcacgaactcggtgatgctgctgttgctgcccccgcgcagctcggcgttggtgaccgaggtgtacatcttgacggggctgtccggaatctccaaaatctcgtggatgtgcgcgatgcccggcgtgtagggcgccacttcggggcagtgcccaatcatgccttgcttgacgggcatcggcggcaaccgcccgcccaggcgctccagcacgcgcagacactcggcaggtttgccggcgatcagcgcgctgctcgagtcgttgacgatcagcaggcgcacgaagcggttgtcgggcccgatcgccttctcgatttcggcgcggctggcgcgaaccaagtagccctgccagaaggactccacgggggcgtccgccggcacgttccatagcttgcgcaaggcctggaactccaccgccagctgtgtcgaccacaccggcgaggtgcgtaggcgctgcgtgagctggtccgacaggccgcagttgcgtcgcgacagcgcaaagagcatggagatctcgccgaggctgaggccgaagcacgccttgggctgcaccccgagcacgtcgcgcgcgtagtcggtgaggcagatggacacgaagatgcccgtgcggaacatctcgatctggtccgcgtcaaaggccgtctgcacggcgcgctgcgagtcggcatccaccgcgcgcggcatgagccacgagtcgccgttctcccacagcgccgcggtcttgtcgttgatgcgctcgtgcaaagccggccacaggcggtgcaggtcgagcccgacgccgtagtaggggctgcggccctcgccgtacatgaacgcgacgcggtcgctggtcacaggtgtcggcgcaaaggcgctgcccgatggcgacatccagttgcgcccggccttggcgcttcgcggtacacccttggctgccagctccaactccttctccagcttctccggcgttgtcagcagggccaaacacaaggtcgccgtggcaccgtgactagccaccgtctcccctacgagccgcaaaaagcgcaagcgatgagcagtgaaagcgacagcagcagctgggtcgtcgtcagtagcagacccggtttcggcgtgcgctcggaggagcgccagctcggcgttgaccttggccatgatatcgtcaacggtgtcgccacggatcgcgatgagcttgggggcggcgtcatccagcgagaggcggttgctgctctcatgagtggcgtactcgtctgtgaggagcacgccaaagcaggacccgctctcggaggcactggcgacagccgccagtcgcgactcgcccgggttcttcagccaggcacgcgagcgcgggcaagtaaacagcgcctcggagaccggcgccaccggccgctcccactgcgggttggccgggaggtagcggttgtggaggcacagcgccgtcttgatgaggctcgcggcgcccgaggcgtacccgacgtctcccacgttggcgcgcacgctgccgatggccaccgagcccggcacctggtgcgcgagcaacttggacacttgctccagctgcgactcggcgctcagcggcgagttggccaagtgcggcgcatggcgacccgagtcggcggcgagctccaccatctccaccaccctcttctcgttgtcgtcgttgtggacttggagtagtagcggcgacacggcttcagcgggctgcgcggcgcacgtgaggcccgcgacactggcgtagaccttgtcgtctgagccaacgtcggcctggcgcttgaggaccagggcgccgctgccctcgccggcaaagtacccgtcggcgctggcctcaaagttggcgcgagggtggtcctgtcggctgatggcggagcggcgcgccttgaggtaaaggttctcggcggtggcacagaggtcgacgccggccaccacgacggcgtccacctggtgcgtgtcgagcaggaacttgcccagctcgaggcagcggtagaccgagtttgcgccttcggtgacggtgaaggacgggcccgtaaagccccactgcgaggacacgcgcgtggccacgaggttgccgatgtacgacgtgtacgacgtcgaggtgccgcagtcgttgatgtagtccatcatctcctgcacctgctcgggcgagaacgcggccgggtcgagccgctccttgagtgtcacgcgcgcgcggtgccggtacagctcggtgtccgtgccgagccccaccagcaccgccaccttgcctcccgtcgccattccagcgtcctgcagcgcgcggtccatcgtagccaccgccagcagctgttgcgggcgcaggacgtcctcagggatcatcggcgaccgcagccgcttgtagtccacgtccacgtcgcgcacgtagcacccgcgcggcacggcgtcgaggcccatggcggtcaagaagtccgtgtcggcgcccaggaaccgccagcgcttgctcggcaggtcgctggcgccgtccgtgcccttgtagatggcctgctcaaacgcgtccaggcccttgagggtaccaaacgtcgcgtccatcccgatgatggcaatcggtccaggagtcacctcgggaagcaccggcgaggctgtcgcagtagcagcaatttggcggtgctcacggaagacacagtgcgcgttggttccaccaaagccaaaggcggagagcgaggcgcacttgagctcatcgcctggtttgcctgcccgcgcctgcgccgacgagtacggccaagggatggcctcgtccacgacgagcgggtcgatgcagttggagcggtcgacaccgggcgtgggcgggatcgtgccgtgctgcatcgacagcagcaccttggccatgcctgcgaacccggccgccacgagagtgtggccaaagttgcccttggtggagcccatgcgcggcgggtggtccgtgttacctcgaaagcagtggcgcagcgcctctacctccacgacgtcgccctgcggagtgcccgtggcgtggcactccacgtactgcacctcgcttgggtcgatgccgacgctcgtgtacaggtcctccatgcacgacttctcgctcggcaggtgcgggctcagcggcaggccgcacccggcgttgctcagactcgtgccgagcaaggtgccgtagatgcggtcgccgtcgcgcacggcgtcctcgaggcgcttcagcaccatgatggcgccgccctctccgggcgtcaggccctggctgccctgccgcagcggcacggacagtgggttatcgtccggtccgcccagcggcatcgcctggaaggtggagaaccccgagagaatgaagaacgggtccggaaagcatgtggcgccgcacagcatcacgtccgcgctgcgcgagagcaagtggtcggacgccagcttgaggcagtacagcgccgacgcgcaggctgcatcgaggctgtagcgcacgggccccaggccgagctggttggccacgaaggacgccgggtcggagtacacgcgcgggtcgctggcctcgggcgagacagcgcgcgggcgctccgaccaggggcgcgagtcgcggaagcgctgggcgcccacgcggttctccacatgcacttggtacagattgagcagctcgccctgcagattgtccatggggaacgacaggcagccgctcacgatgccgaagtcgcgtaggttggcggtggtgctggcgtcgtcgaggttaattccggcgtcgagcagggcgcgccgggccaggtcggcgaggaggtcgtgctcgttgtcgacgctggcatcgacgcagccgtagcgatcgttgcagaaggtgtcggcgtacttgctgcgctgcgggtggaagtggaggtcgcggtagcgcgtaccgaggcgctccgccgagatcgggctcgagttgatctccttacgcatcagcgtatcccagaactcgtcctggttcttgcatccggcatactgcaccgccatgcccacgaccgcaatgttatcgcacggcatttttggttgtggatccgatcttgtagtgatgagttttggtttgagtaaaaagtgaagccgagcctctaatttataggtgagaatggagatttgcatggcgatcacgtgtaaatattgcatgcatatgtgtgtgtgctgtgagagagaagctcttttaggtgtttgaagtgagtgacaaatcgtccgcatctgcatgctaatatgtgatgtgtagctcatgtcctggcgtgacatcttatgaacgatatttttcaaaaaagaaggtaaaaacttaaacttcaaaaaataaaaacttaatgagaattcagaacatagtccacaagtcattaccttgaagaaatgttttttttagtgtgatagattcagcacaattggcacagaaggtggcaactccgagtgattcgacattattaaaaatataagatttgaatattttggtttggtgtggctttctcacattgcacttatcagatattcagacactgagaaagaaacagaaacatatctaaagacgcattaaacaacgcaaatggatgatatcaataagataaaagcacacacttgaagggctttaaaaagctctcaaatctttctactactcaattgcatcttctcttttgttactcgtacatacataccaagacacatccctttcatcacattcaaccaaagagactgcgtctggttttacgtctttgattggtattatgacgaccctgaggctcgctccaattgtcttcggctttctaacacaacacatgatgcttaagtgtgtatcatcagcacactgtcctgccatagcatattgatgcaatgtacagattcttcgcccatttgtcctgaaaaaaaaaaaattcaaccaaaagctctcaggtcctatgtatatggaaacaaaacaaaaagatccaaatctgtgttcaaagctaaagaaaccaaccttgacatgagtacttggaaaggcggtggtgcggagagtctcttgagtttcatccaccatcttacgctttggtatgcttaatatgaaagctgcttgatccgcagttgctgccattgatgttattctatacccattctcccacctcctatgtatcccatcgcttgggtacaaaaagtcaagctccaccacctttcacaacgcagagtttatcatattagactatcaggggaaaataaaaacaccagacaataagagacaaaaacctacctgatcagagaagccagagttcctcgacattaccacaccccaacgattaccagcagttgtcatggaggttacatgaaaatcttctttccatttcttatttatccacttgaatggaaatgagtcactcactttgtatgactgctgagaataagtagttcctaccaattcacaacaagtatataaataagtcaatgaagactttttgataataagtttattattcactaaacactaaccttttgacataacaactaaagagctcccgttatctgaacccgctatggagcttatatagtagttcttttcccattgttccataatccagtcctgcggggaaatcataaggtaagttcttcttagtttactacaaatcagattgattcttaattgcttcaactgattattaccttgtgtaggaagaccggtgacaactcataaacttgagaagtgaatccagttccagcatccatgatgagagcccagagattagctgctgatgctacacagctaatcaaaaggccatcttcatttcccttctgtatatgctggcgcagccttgtctctccaacattgtagtgatatctaccaaaagattacacagttagtgaggaactatcaaagtgtatatgcaaaaaatgtgttacctctgtttcatgggacgacgaccgttatagactgagatccattgagtagcaggactgcctattcttattttcttcttcggctgttcatcatcttccaaattgagaagcaatcttcctcgtttttgcccaacctacatatgccaaaagaagcactttcagagaatatttatacacaagtttagaagttaatcatatgaacaagaaaacagccagcaacctttagagctccatcaattctaattggtctagatagagcgcacggctcaattagagtatcgaaaagagaaataagctgcggccgcttaattaacctaggtctagatcgacacccagcttt

SEQ ID NO: 32 - DNA, 37478 bp, Artificial Sequence
  Plasmid pDAB117502
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggatactcgcatcgcgatcgtggggatgtcggcgatcctgccgagcggggagaacgtgcgcgagagctgggaggcgatccgcgatgggctggattgcctgagcgatctgccggcggaccgcgtggacgtgacggcctactacaacccggagaagacgaccaaggacaagatctactgcaagcgcggcgggttcatcccggagtacgacttcgacgcgcgtgagttcgggctcaacatgttccagatggaggactcggacgccaaccagacgatctcgctgctcaaggtgaaggaggcgctgacggacgccaacatcccggcgttctcgagcggtaagaagaacatcggctgcgtgctgggcatcggcggcggccagaaggcgagccacgagttctactcgcggctcaactacgtggtcgtggacaaggtgctgcgcaagatgggcctgccggaggaagacgtggcggcggcggtggacaagtacaaggcgagtttccccgagtggcgcctcgactctttccccgggttcctgggcaacgtcacggcggggcgctgctgcaataccttcaacatggagggcatgaactgcgtcgtggacgcggcctgcgcgtcgtcgctgatcgcggtcaaagtggcgatcgaggagctgctctacggcgactgcgatgcgatgatcgcgggtgccacctgcacggacaactcgatcgggatgtacatggccttctccaagacgcccgtgttttccacggacccgagcgtcaaggcgtacgacgccgccaccaaaggcatgctcatcggcgagggctcggcgatgctcgtgctgaagcgctacgcggacgccgtgcgcgacggcgacaccgtgcacgccgtcatcaaggggtgcgcgtcctcgagcgacggcaaggcggcgggcatctacacgccgacaatctcgggccaggaggaggccctgcgccgcgcctacgcccgcgccaatgtcgacccggccactgtgacgctggtggagggccacggcacgggtacgccggtgggcgacaagatcgagctgacggcgctgagcaacctcttctccaaggcgttttctgccaacggtggcggcgcggaggaagcagagcaggtggcggtgggcagcatcaagtcgcagatcgggcacctcaaggcggtggccgggctggccgggctggtcaaggtggtgctggcgctcaagcacaagacgctgccgcagacgatcaacgtcgacaagccgccgtcgctggtggacgggaccccgatccagcagtcgccgctgtacgtcaacacgatgaaccgcccctggttcacgcccgtaggggtgccgcgccgcgccggcgtgtcgtcgtttgggtttggcggtgccaactaccacgccgtgctggaggagtttgagcccgagcacgagagcgcgtaccggtacaacaacctgccgcaggtggcgctgctgcacgcgggggacgtcgcgaccttggcggcgacggttcgcgccaagctggcgctggccaccgccgagcaggaagaggcgcgtgtggtgaagaacgcggactacatcgcgtaccaccggttcctggacgagtgcaagttgcgcggcgctgtgccgcaggcgcacgcgcgggtgggactgctcgtacgggacctgagctcgctcatcgccgtgctcgaggccgctgccgccaagctcgcgggcgaagagagcgcgacggagtggacggtcagcgttgctacgggcgaggcggccttccgcgtgcgcggtgtggctacggaggccaacgtggcggcgctgttctcgggccagggcgcgcagtacacgcacatgttcagcgacgtggcgatgaactggcccccgttccgcgagagcgtcgccgccatggaccgcgcccagcgcgagcgcttcgggcggcctgccaagcgcgtgagcagcgtgctgtacccgcgcaagccgtacggcgacgaaccgcggcaggaccacaaggagatctcgcaaacgcgctactcgcagcccgcaacgctcgcgtgctcggtcggcgcctttgacatcttcaaagcggcgggactggcgccgagctttgcggcgggccactcgctgggcgagtttgcggcgctctacgcggccgggtcgctcgatcgcgacgccgtcttcgacctggtctgcgcgcgcgccaaggccatgagcgacttcacggcccaggccagcagcagcggtggcgccatggcggccgtgattggcgccaaggcggaccagctctcgctgggtggcgcgcccgacgtgtggctcgccaacagcaactcgccctcgcagaccgtgatcacgggaaccgccgaagcagtggctgcggcctctgacaagttgcgctgcagcggcaacttccgcgtcgtgcctctggcctgcgaggcggccttccactcgccgcacatgcgcggcgcggagcagacgtttgcgtcggcgctcgcgcaggcgcccgtgtcggcaccggcggctgctcggttctactctaacgtgacggggggcgccgcggtaacctcgcccgcggacgtcaaaacgaacctgggcaagcacatgacgagccctgtgcagttcgtgcagcaggtgcgagccatgcacgcggcgggcgcgcgtgtgtttgtggagtttgggcccaagcaggtcctgtcgcgcctcgtcaaggagacccttggcgaggccggcgacgtggtcacggtcgccgtcaacccagactcggccaaggacagcgacacgcagctgcgccaggcggcgctcacgttggcggtcgccggcgtgccgctcaaggactttgaccgctggcagctgccggatgccacgcgcctcgagcctgtcaagaagaagaagaccacgttgcggctctcggcagccacctacgtctccgccaagacgttgcgccagcgcgaggccgtgctcaacgacggctacactgtcagtggtgccacggcggtagtcaaggaagtggacacggccaacgaggagcgtctcgtccgccaagcccaggatctccagcgccagctcgcggaggcctcgacggcagcccaggcggcgcagtccaaggtcgcggagctcgagcgcacgatccaggacttggagcgcaaggtgcagcagcagcagcaagagaagggtgagaactcagacagcaacgctgccgccgaagtgctgcggcgccacaaggagctgctccagcgcatgctgcaggactgtgacgagcaggcagtgcccgtagccacggtggttccgacacctacgtcctccccgacgcctacatcctcacccgtatccggcaacagcaagagcactcgtggcagtgctgatctgcaagcgctgctggccaaggcggagactgtggtgatggctgtgctggctgccaagactggctacgaggccgacatggttgaggcggacatggacctggaggccgagctcggcatcgactcgatcaagcgcgtggagatcctttccgaggtgcagggccagctgggcgtcgaggccaaggacgtggatgcgctgagccgcacgcgcacggtcggtgaggttgtggacgccatgaaggcggagatcgtggctgcctctggtggtagtgctcctgcggttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctgctggtagtgctcctgctcctgctgttccttcggcgcccgctgcttctgcagctccgactcccgctgcttcgactgcgccttctgctgatctgcaagcgctgctgtccaaggcggagacggtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctcctgcggttccttcggcgcccgctgcttctgcagctccgactcccgcggctgcgacagcgccttctgctgatctgcaagcgctgctggccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaggttgtggatgccatgaaggcggagatcgtggctgcctctgctggtagtgctcctgctcctgctgttccttcggcgcccgctgcttctgcagctccgactcccgctgcttcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctctcggaggtgcagggccagctgggcgtcgaggccaaggacgtggatgcgctgagccgcacgcgcacggtcggtgaggttgtggatgccatgaaggcggaaatcgtggctgcctctggtggtagtgctcctgctgctgctgttccttcggcgcccgctgcttctgcagctccgactcctgcgactgcgccttctgctgatctgcaagcgctgctgtccaaggcggagactgtggtgatggctgtgctggcggccaagactggctacgaggccgacatggtcgaggcggacatggacctggaggccgagctcggcatcgactcgatcaagcgcgtggagatcctttccgaggtgcagggccagctgggcgtcgaggccaaggacgtagatgcgctgagccgcacgcgcacggtcggtgaagtggtggacgccatgaaggcggagatcgtggctgcctctggtggtagtgctcctgctgctccttcggcgcccgcgcttcttccaacgctgtttggttccgagtgcgaggacctgtctctgacctttcccgtgataacgaccctgccgcttcctgcagagcttgtgctggccgagggcggcgctcgccctgtagtcgtggtggatgatggatctgcactcacctcgtcgctggtgtcctcgctcggcgatcgtgcggtgctgctgcaggtgcagtcttcctctgcctgctcgccgcgctcgaccacgcacaagttggtgaccgtagcagaccgctctgaagcggcgctacaggcggcgctcacgtccgtcgaggcgcagttcggcaaggtgggtggctttgtgttccagttcggcgacgacgacgtgcaagcgcagctcggctgggcgctgctcgcggccaagcacctcaaaacttcgctgtcagaacagatcgagggcggtcgcacctttttcgtggccgtcgcgcggctcgacggccagctggggctctccggcaagtcgacgaccgctaccgttgatctctcccgcgcgcagcagggcagcgtgttcggcctgtgcaagacactcgacctggagtggcccgctgtcttctgccgcggaatcgacctggccgccgacctcgacgccgcacaggccgcgcggtgcctgctgggcgagctgtcagaccccgacgtggccgtgcgcgagtctggttactccgcctcgggccagcgctgcacgacaactacgaagtcgctgactacgggcaagccgcaccagccgatctcctcgtcggacctctttctggtgtcgggcggcgcgcgcggcatcaccccgctgtgcgtgcgcgagctggcgcagcgcgtgggcggcggcacgtacgtgctcatcggccgctcggagctgcccacgacggagcctgcctgggcggtcggcgtggagtctggcaagccgctggagaaggccgcgctggcgttcctgaaggcggagtttgcagcgggccgcggggccaagccgacgccgatgctgcacaagaagctcgtgggcgccgtggtcggagcgcgcgaggtgcgagcctcgctcgccgagatcactgcacagggcgccacggctgtgtacgagtcgtgcgacgtgagctctgccgccaaggtgcgtgagatggtagagcgcgtgcagcagcagggcgggcggcgcgtgtcgggcgtgttccacgcgtcgggcgtgctgcgcgacaagctcgtggagaacaagtcgctggcggacttcagcgccgtgtacgacaccaaggtgggcggcctcatcaacctgctggcctgcgtggacctggcgcagctgcgtcacctcgtgctcttcagctcgctcgcgggcttccacggcaacgtcgggcagtcggactacgcaatggccaacgaggcgctcaacaagctggcggcgcacctgtcggcggtgcacccgcagctgtgcgcgcgctcgatctgcttcggaccgtgggacggcggcatggtgacccccgcgctcaaggccaacttcatccgcatgggcatccagatcatcccgcgccaaggcggcgcgcagaccgtcgccaacatgctcgtcagtagctcccccggtcagctgctcgtgggcaactggggcgtgccacccgtcgtgccgagtgccaccgagcacaccgtgctgcagacgctccgccagagcgacaaccccttcctcgactcgcacgtgatccagggccgccgcgtgctgcccatgaccctggccgtgggctacatggcgcaccaggcgcagagcatctacgcgggccaccagctgtgggccgtcgaggacgcccagctcttcaagggcatcgccatcgacaatggcgccgacgtgcccgtgcgcgtggagctgtcgcgccgcaaggaggagcaggaggacgccggcaaggtcaaggtcaaggtgcaggtgctgctcaaatcgcaggtcaacggcaagtcggtgcccgcgtacaaggcgaccgtcgtgctgtcccctgcgccgcgccccagcgtcatcacgcgtgacttcgacctcaccccggacccggcctgcacggagcacgacctctacgacggcaagacgctcttccacggcaaggccttccagggcatcgagcaggtgctctcggcgacgcccaagcagctcaccgccaagtgccgcaatttgcccctcacgcccgagcagcgcggccagttcgtcgttaacctcagccagcaggacccgttccaggcggacattgcgttccaggcgatgctcgtctgggcgcgcatgctgcgccaatcggcggccctgcccaacaactgcgagcgcttcgacttttacaagccgatggccccgggcgccacctactacacgtcggtcaagctggcctcggcctcacccttggtggactctgtgtgcaagtgcaccgtggcgatgcacgatgagcaaggtgaggtgtacttttctgctcgtgccagcgtcgtcctcaacaagaccctcacgtactaagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatgtccaacagtctcagggttaatgtctatgtatcttaaataatgttgtcggtattttgtaatctcatatagattttcactgtgcgacgcaaaaatattaaataaatattattattatctacgttttgattgagatatcatcaatattataataaaaatatccattaaacacgatttgatacaaatgacagtcaataatctgatttgaatatttattaattgtaacgaattacataaagatcgaatagaaaatactgcactgcaaatgaaaattaacacatactaataaatgcgtcaaatatctttgccaagatcaagcggagtgagggcctcatatccggtctcagttacaagcacggtatccccgaagcgcgctccaccaatgccctcgacatagatgccgggctcgacgctgaggacattgcctaccttgagcatggtctcagcgccggctttaagctcaatcccatcccaatctgaatatcctatcccgcgcccagtccggtgtaagaacgggtctgtccatccacctctgttgactacagccactgcagccgcatggacctcacgtgccaactagtgctagcctcgaggtcgacacaactttgtatacaaaagttgtctaggtcgacctcgaggctagcactagtttaattaagcggccgctaagtcaataacaaatcttaaaactgaactttattttttttattactgcttatcgttctttgcttctaaagagtcttcaccaaataaaagaacacttgcataatttagtgcatacaaaaatagtttcgaagtatctgatcaaaaccagatttgagtctttgttggatcccattggatgatcttttatcactagccttgaaggcttgattagacatctagaaaaagaaaatctgacatgttcaatagactagtactgcttcattgtgaatatagattaattgttttctttttggtgtatctgttgttaatcatcactttataggaaagtagcaagagtaaaaaaaaaaacttctcttttattaccgtctacggagtagttcttattacattagtacattatttatggaacacacaccatgactatgtagtgttaacatacatcaacaaccacactcatatcaccgtggtatacacactctcgaggatatttcgtttggaatggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcttgtagtgatgagttttggtttgagtaaaaagtgaagccgagcctctaatttataggtgagaatggagatttgcatggcgatcacgtgtaaatattgcatgcatatgtgtgtgtgctgtgagagagaagctcttttaggtgtttgaagtgagtgacaaatcgtccgcatctgcatgctaatatgtgatgtgtagctcatgtcctggcgtgacatcttatgaacgatatttttcaaaaaagaaggtaaaaacttaaacttcaaaaaataaaaacttaatgagaattcagaacatagtccacaagtcattaccttgaagaaatgttttttttagtgtgatagattcagcacaattggcacagaaggtggcaactccgagtgattcgacattattaaaaatataagatttgaatattttggtttggtgtggctttctcacattgcacttatcagatattcagacactgagaaagaaacagaaacatatctaaagacgcattaaacaacgcaaatggatgatatcaataagataaaagcacacacttgaagggctttaaaaagctctcaaatctttctactactcaattgcatcttctcttttgttactcgtacatacataccaagacacatccctttcatcacattcaaccaaagagactgcgtctggttttacgtctttgattggtattatgacgaccctgaggctcgctccaattgtcttcggctttctaacacaacacatgatgcttaagtgtgtatcatcagcacactgtcctgccatagcatattgatgcaatgtacagattcttcgcccatttgtcctgaaaaaaaaaaaattcaaccaaaagctctcaggtcctatgtatatggaaacaaaacaaaaagatccaaatctgtgttcaaagctaaagaaaccaaccttgacatgagtacttggaaaggcggtggtgcggagagtctcttgagtttcatccaccatcttacgctttggtatgcttaatatgaaagctgcttgatccgcagttgctgccattgatgttattctatacccattctcccacctcctatgtatcccatcgcttgggtacaaaaagtcaagctccaccacctttcacaacgcagagtttatcatattagactatcaggggaaaataaaaacaccagacaataagagacaaaaacctacctgatcagagaagccagagttcctcgacattaccacaccccaacgattaccagcagttgtcatggaggttacatgaaaatcttctttccatttcttatttatccacttgaatggaaatgagtcactcactttgtatgactgctgagaataagtagttcctaccaattcacaacaagtatataaataagtcaatgaagactttttgataataagtttattattcactaaacactaaccttttgacataacaactaaagagctcccgttatctgaacccgctatggagcttatatagtagttcttttcccattgttccataatccagtcctgcggggaaatcataaggtaagttcttcttagtttactacaaatcagattgattcttaattgcttcaactgattattaccttgtgtaggaagaccggtgacaactcataaacttgagaagtgaatccagttccagcatccatgatgagagcccagagattagctgctgatgctacacagctaatcaaaaggccatcttcatttcccttctgtatatgctggcgcagccttgtctctccaacattgtagtgatatctaccaaaagattacacagttagtgaggaactatcaaagtgtatatgcaaaaaatgtgttacctctgtttcatgggacgacgaccgttatagactgagatccattgagtagcaggactgcctattcttattttcttcttcggctgttcatcatcttccaaattgagaagcaatcttcctcgtttttgcccaacctacatatgccaaaagaagcactttcagagaatatttatacacaagtttagaagttaatcatatgaacaagaaaacagccagcaacctttagagctccatcaattctaattggtctagatagagcgcacggctcaattagagtatcgaaaagagaaataagctgcggccgcttaattaacctaggtctagatcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccatgacatcatcgaagaagactcccgtgtgggagatgagcaaggaggagctgctggacggcaagacggtggtcttcgactacaacgagctgctcgaattcgccgagggcgacgtgggccaagtgttcggacccgagttcgacatcatcgacaagtaccggcgtcgcgtgcggctgccggcgcgcgagtacctgctcgtgtcgcgcgtgacgctgatggacgccgaggtgaacaacttccgcgtcgggtcgcgcatggtgaccgagtacgacgtgcccgtgaacggggagctgtcggagggcggggacgtgccgtgggcggtgctggtggagtcggggcagtgcgacctgatgctcatctcgtacatgggcatcgacttccagtgcaagggcgaccgcgtgtaccgcctgctcaacacatcgctcaccttcttcggggtggcgcacgagggcgagacgctggtgtacgacatccgcgtcacggggttcgccaagggcgcgggcggggagatctcgatgttcttcttcgagtacgactgcttcgtggacggccgcctgctgatcgagatgcgcgacgggtgcgccgggttcttcacggacgccgagctggccgccggcaagggcgtgcttaagaccaaggcggagctggcggcgcgcgcgcagatccagaagcaggacatcgcgccctttgcgccggcgccgtgctcgcacaagacctcgctggacgcgcgcgagatgcggctgctcgtggaccgccagtgggcgcgcgtcttcggcagcggcatggcgggcatcgactacaagttgtgcgctcgcaagatgctcatgatcgaccgcgtcacgcacctcgacccgcgcggcggcgcgcacggcctcgggctgctgatcggggagaaggtgctggagcgcgaccactggtacttcccctgccactttgtgcgcgacgaggtgatggccgggtcgctggtcagcgacggctgctcgcagctcctcaaggtgtacatgctgtggctcggcctgcacacgaccgtgggcgcgttcgactttcgtcccgtgagcgggcacgccaacaaggtgcggtgccgcgggcagatctcaccgcacaagggcaagctcgtgtacgtgatggagatcaaggaaatgggctttgacgcgaagacgggcgatccgtttgcgatcgcggacgtggacatcatcgacgtcaacttcgaggagggacaggcgtttgcgggagtggaagacctgcacagctacggccagggcgacctccgcaagaagatcgtcgtcgacttcaagggcatcgcgctctccctgcagaagcggaaggagcagcagaaggaaagcatgaccgtgactacgacgacgacgacgacgagccgggtgattgcgccgcccagcgggtgcctcaagggcgacccgacggcgccgacgagcgtgacgtggcacccgatggcggagggcaacggcgggcccggaccgacgccgtcgttctcgccgtccgcgtacccgccgcgggcggtgtgcttctcgccgttccccaacaacccgcttgacaacgaccacacgccgggccagatgccgttgacctggttcaacatgtccgaattcatgtgcggcaaagtgtccaactgcctgggccccgagtttgcgcgcttcgacgcgagcaagacgagccgcagcccggcctttgacctggcgctcgtgacgcgggtgacgagcgtggcggacatggagcacgggccgttctacaacgtggacgtcaacccgggccagggcacgatggtgggcgagttcgactgtcccgcggacgcgtggttcttcggcgcctcgagccgcgacgaccacatgccgtactcgatcctgatggagatcgcgctgcagacgtcgggcgtcctcacctcggtgctcaaggcgccgctgacgatggacaaggacgacatcctcttccgcaacctcgacgcagacgccgagctcgtgggcgacgccatgccggacgtgcgcggcaagacgatccgcaacttcaccaagtgcacaggctacagcatgctcggcaagatgggcatccaccgcttcacctttgagctcagcgtcgacggcgccgtcttctacaagggcagcacctcgtttggctggttcgtccccgaggtcttcgagtcgcagaccggtctcgacaacggcaagccgcgcctgccttggtaccgcgagaacaacgtcgccgtcgacacgctctccgcgcccgcctccgcttcctccgcgcaaggtcagctgcagctgcagcgacgcgggtcgcaggcgcagttcctggacacaatccacctggcgggcagcggcgccggcgtgcacggccagggctacgcgcacggggagaaggccgtgaacaagcaagattggttcttctcgtgccacttctggttcgaccccgtgatgcccgggtccctgggcatcgagtcgatgttccagctcgtcgaggcgtggtgcgtgaagcagggactcgcggcgcggcacggcatcgctcacccagtgttcgcgcacgcgcccggggccacgagctggaagtaccgcgggcagctaacccccaagaacgaccgcatggacagcgaggtgcacatcaagtcggtggcggccttctcctcctgggtcgacgtcgtcgcggacgggttcctcttcgtcgacggcctccgcgtctactcggcagacaacctccgcgtccgcatccagaccggcgccggccacgttgaagagcaagaggttgctgccaaggccacaaccaagaacagcagtattgctgatgtggacgtggcggacctgcaagcgctcaagcaggcgttgctgacgctggagcgaccgctgcagctggacgcggggagcgaggtgcccgcctgcgcggtgagcgacctgggcgataggggcttcatggagacgtacggggtggtggcgccgctgtacagcggggcgatggccaagggcatcgcgtcggcggacctggtgatcgcgatgggccagcgcaagatgctggggtcgtttggcgcgggcgggctcccgatgcacgtcgtgcgcgcggggattgagaagatccaggcagcgctgccagcggggccatacgcggtcaacctgattcactcgccttttgacgccaacctggagaagggcaacgtggacctcttcctggagaagggcgtgcgcgtcgtggaggcgtcggccttcatggagctcacgccccaggtggtgcgctaccgcgcgacgggcctctctcgcgacgcgcgcggcggctccgtgcgcacggcccacaagatcatcggcaaggtcagccgcaccgagctggccgagatgtttatccggcccgcgccgcaagccattctcgacaagcttgtggcgtccggcgagatcacccccgagcaggcggcgctggcgctcgaggtgcccatggcggacgacatcgccgtcgaggccgattcgggcgggcacaccgacaaccgccccatccacgtcatcctgcccctcatcctcagcctgcgcaaccgcctccagcgcgagctcaagtaccctgcgcgacaccgcgtgcgcgtcggcgccgggggcggcatcgggtgcccgcaagcggctctgggcgccttccacatgggcgccgcgtttgtggtgacgggcacggtcaaccagctgagccggcaggccgggacatgcgacaatgtgcggcggcagctgtcgcgcgcgacgtactcggacatcacgatggcgccggcggcggacatgttcgagcagggcgtcgagctgcaggtgctcaagaagggcacgatgtttccctcgcgcgccaagaagctgttcgagctgtttcacaagtacgactcgttcgaggcgatgccggcggacgagctggcgcgcgtcgagaagcgcatcttcagcaagtcactcgccgaggtgtgggccgagaccaaggacttctacatcacgcggctcaacaacccggagaagatccgcaaggcggagaacgaggaccccaagctcaagatgtcactctgcttccgctggtacctcgggctcagctcgttctgggccaacaacggcatcgcggaccgcacgatggactaccagatctggtgcggccctgccatcggcgccttcaacgacttcatcgccgactcgtacctcgacgtggccgtctcgggcgagttccccgacgtcgtgcagatcaacctgcagatcctgtcgggcgcagcctacctccagcgcctcctctccgtcaagctcgcaccgcggatcgacgtcgacaccgaggacgacctcttcacctaccgccccgaccacgcactctaaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctaggtcgatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtcgacctcgaggctagcactagtttaattaagcggccgctcagtctgaaagacccaaaaacaaatgcaatttcttttctggtagaccgtgacaatttgtctaagatgtatctgatttaatgccttttgtatataatacactcatctaatctagttaatttagcttcagagtaaattacttcagcatatttatacgtgccaagtgccaaccatatcaaattagctaagcagacagttgaagtacacaaaacaaaagcatcatatgctgatttatttattcatagatggagctcaagtcatagttaaatagcccgatactttcctcgctcactatgagctattacagcatacattttagtactacatacttatgggtgaccttatacgatgatgtattctacgtcgtcgtcctgttgttgttgctgcacgcggcggtagtgcgaggctccgaggaggatgtgctggttgatgtccacgacgcgcggaaactcgccggtgccagcggtcgcgtccagcttggtgccgcgaacgaagtcgttgaagctgccgatggcggggccgcaccagatctggtagtccgccttgcgcgcggacgtcgcctcggtagcccatcgcgacgactgcgacatgtaccagcgcacacagagcgccatcctctcctgcggacttgcagcggtagcgtcgacaccaaacttttcgcgtgcagcagcccacacgtccgccacggactgcttgaacacggagcgctcgagcttgcgcagctgcggctccggcacggcgtcaaaggagccgaacttggcctgcagctgggcgagcatcgtggcccgcgcggcgaacatggtctgcttcttgagcacctggacgccgcccggcgccatggccacgtccgagtaggtggccgtcgccagcagtagtcggaccgcgtcgctggtgccagcctcgcgggccagttggttgacggacccggtgaccacaaaggcggcgcccagggaaaaggcgagcagcgcggcgcgcggacaggcgatcccgccgccggcgccgacgcgcactggcgtgtccaccaggtggcgccagcggttgcgctgcgccaccacgagcggcagcagcacgtggatcggtcggttgtcggtgtgcccgcccgagtcggcctccaccgcgacgtcgtcggccatggcgacgcggctggccagcgcggcctgctcgggcgtaatctgtttggcggcgaccaaagcctctagtacggcggccggcgccgggcgcagaaagtgctcggccacctcggtgcgcgacaccttggcgaccacacggtgagtcgccgacacagaagcaccgcaactagttcgtcgcagacccgtgacacggtagcgcaccaggtctgcagagagcgcgccggtgtagcccgatgcctcgacgattgagacgcccgtgcgcagcagcgcgtccaccgtcgcggcctcgtcaggacccggcatcaggttgacagcaaaggcgttggaggtgcgttgctggatctcacggatctggagttccacctggtccataggcaagcgggccgctccgaatgatgccagcatgcgggcctcggcggcagcgaccaccaggtctaccgacgagatgccttccgccatggcgcccatgtagagcggccagtccacgtcgtagcagcgcagaaaggcgtcatccccaaccaacaacgacgacgacgtctgcttggccttgaccacgggcgtcgaatcagcaaccacagcaccagcagcagcaaccacaactgccttggctgggtgcaaacgaaccatgcaatgcgtcgagggtttggcacttgcagcagcaacctgcttgctgatgccgtcggggcaaaagtacccgttgacctctacgctgcgaaggaagcggttgggcttgggcgggggctcctgcatcgcagagtcgatagccgtcaggaacgtggggtggtacaggtccgcaaacagagtcgggttgtgcaggggcacgcggtgggcggtcagcagcgccagcgacttgagggtctgcgtccacgccgactcactggggcggtccagcgccacggagacatgcggggtggcagccttgccaagaatgtcactgaccgcggcggagcgcatgttgttcggccccacctcgacgaagacatcgtggccgtcacggctgaccttgtcgacgatgcccggaaagtcggcgatgcgcgtgtacaacttctgcacgaactcggtgatgctgctgttgctgcccccgcgcagctcggcgttggtgaccgaggtgtacatcttgacggggctgtccggaatctccaaaatctcgtggatgtgcgcgatgcccggcgtgtagggcgccacttcggggcagtgcccaatcatgccttgcttgacgggcatcggcggcaaccgcccgcccaggcgctccagcacgcgcagacactcggcaggtttgccggcgatcagcgcgctgctcgagtcgttgacgatcagcaggcgcacgaagcggttgtcgggcccgatcgccttctcgatttcggcgcggctggcgcgaaccaagtagccctgccagaaggactccacgggggcgtccgccggcacgttccatagcttgcgcaaggcctggaactccaccgccagctgtgtcgaccacaccggcgaggtgcgtaggcgctgcgtgagctggtccgacaggccgcagttgcgtcgcgacagcgcaaagagcatggagatctcgccgaggctgaggccgaagcacgccttgggctgcaccccgagcacgtcgcgcgcgtagtcggtgaggcagatggacacgaagatgcccgtgcggaacatctcgatctggtccgcgtcaaaggccgtctgcacggcgcgctgcgagtcggcatccaccgcgcgcggcatgagccacgagtcgccgttctcccacagcgccgcggtcttgtcgttgatgcgctcgtgcaaagccggccacaggcggtgcaggtcgagcccgacgccgtagtaggggctgcggccctcgccgtacatgaacgcgacgcggtcgctggtcacaggtgtcggcgcaaaggcgctgcccgatggcgacatccagttgcgcccggccttggcgcttcgcggtacacccttggctgccagctccaactccttctccagcttctccggcgttgtcagcagggccaaacacaaggtcgccgtggcaccgtgactagccaccgtctcccctacgagccgcaaaaagcgcaagcgatgagcagtgaaagcgacagcagcagctgggtcgtcgtcagtagcagacccggtttcggcgtgcgctcggaggagcgccagctcggcgttgaccttggccatgatatcgtcaacggtgtcgccacggatcgcgatgagcttgggggcggcgtcatccagcgagaggcggttgctgctctcatgagtggcgtactcgtctgtgaggagcacgccaaagcaggacccgctctcggaggcactggcgacagccgccagtcgcgactcgcccgggttcttcagccaggcacgcgagcgcgggcaagtaaacagcgcctcggagaccggcgccaccggccgctcccactgcgggttggccgggaggtagcggttgtggaggcacagcgccgtcttgatgaggctcgcggcgcccgaggcgtacccgacgtctcccacgttggcgcgcacgctgccgatggccaccgagcccggcacctggtgcgcgagcaacttggacacttgctccagctgcgactcggcgctcagcggcgagttggccaagtgcggcgcatggcgacccgagtcggcggcgagctccaccatctccaccaccctcttctcgttgtcgtcgttgtggacttggagtagtagcggcgacacggcttcagcgggctgcgcggcgcacgtgaggcccgcgacactggcgtagaccttgtcgtctgagccaacgtcggcctggcgcttgaggaccagggcgccgctgccctcgccggcaaagtacccgtcggcgctggcctcaaagttggcgcgagggtggtcctgtcggctgatggcggagcggcgcgccttgaggtaaaggttctcggcggtggcacagaggtcgacgccggccaccacgacggcgtccacctggtgcgtgtcgagcaggaacttgcccagctcgaggcagcggtagaccgagtttgcgccttcggtgacggtgaaggacgggcccgtaaagccccactgcgaggacacgcgcgtggccacgaggttgccgatgtacgacgtgtacgacgtcgaggtgccgcagtcgttgatgtagtccatcatctcctgcacctgctcgggcgagaacgcggccgggtcgagccgctccttgagtgtcacgcgcgcgcggtgccggtacagctcggtgtccgtgccgagccccaccagcaccgccaccttgcctcccgtcgccattccagcgtcctgcagcgcgcggtccatcgtagccaccgccagcagctgttgcgggcgcaggacgtcctcagggatcatcggcgaccgcagccgcttgtagtccacgtccacgtcgcgcacgtagcacccgcgcggcacggcgtcgaggcccatggcggtcaagaagtccgtgtcggcgcccaggaaccgccagcgcttgctcggcaggtcgctggcgccgtccgtgcccttgtagatggcctgctcaaacgcgtccaggcccttgagggtaccaaacgtcgcgtccatcccgatgatggcaatcggtccaggagtcacctcgggaagcaccggcgaggctgtcgcagtagcagcaatttggcggtgctcacggaagacacagtgcgcgttggttccaccaaagccaaaggcggagagcgaggcgcacttgagctcatcgcctggtttgcctgcccgcgcctgcgccgacgagtacggccaagggatggcctcgtccacgacgagcgggtcgatgcagttggagcggtcgacaccgggcgtgggcgggatcgtgccgtgctgcatcgacagcagcaccttggccatgcctgcgaacccggccgccacgagagtgtggccaaagttgcccttggtggagcccatgcgcggcgggtggtccgtgttacctcgaaagcagtggcgcagcgcctctacctccacgacgtcgccctgcggagtgcccgtggcgtggcactccacgtactgcacctcgcttgggtcgatgccgacgctcgtgtacaggtcctccatgcacgacttctcgctcggcaggtgcgggctcagcggcaggccgcacccggcgttgctcagactcgtgccgagcaaggtgccgtagatgcggtcgccgtcgcgcacggcgtcctcgaggcgcttcagcaccatgatggcgccgccctctccgggcgtcaggccctggctgccctgccgcagcggcacggacagtgggttatcgtccggtccgcccagcggcatcgcctggaaggtggagaaccccgagagaatgaagaacgggtccggaaagcatgtggcgccgcacagcatcacgtccgcgctgcgcgagagcaagtggtcggacgccagcttgaggcagtacagcgccgacgcgcaggctgcatcgaggctgtagcgcacgggccccaggccgagctggttggccacgaaggacgccgggtcggagtacacgcgcgggtcgctggcctcgggcgagacagcgcgcgggcgctccgaccaggggcgcgagtcgcggaagcgctgggcgcccacgcggttctccacatgcacttggtacagattgagcagctcgccctgcagattgtccatggggaacgacaggcagccgctcacgatgccgaagtcgcgtaggttggcggtggtgctggcgtcgtcgaggttaattccggcgtcgagcagggcgcgccgggccaggtcggcgaggaggtcgtgctcgttgtcgacgctggcatcgacgcagccgtagcgatcgttgcagaaggtgtcggcgtacttgctgcgctgcgggtggaagtggaggtcgcggtagcgcgtaccgaggcgctccgccgagatcgggctcgagttgatctccttacgcatcagcgtatcccagaactcgtcctggttcttgcatccggcatactgcaccgccatgcccacgaccgcaatgttatcgcacggcatttttggttgtggatccaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctgcggccgccctaggtctagatcgacacccagcttt

SEQ ID NO: 33 - DNA, 35035 bp, Artificial Sequence
  Plasmid pDAB112200
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcatcagtatgtgagtgtcttgttgaggacaacactggctctcgcagagaagtacacttcaccttgctcatcgtgcatggcaacagtgcatttgcacacagaatccaccaatggtgaagctgaagccagtttgacactggtatagtaagttgctccaggagccatcggtttgtagaaatcaaacctttcacagttattgggcagcgcagcagactgtctcaacatcctagcccaaacaagcatggcttggaaagcaatgtcagcttggaatgggtcttgctggctgagattgaccacaaactggccacgctgctccggtgtgagtggaaggtttctgcatttggcagtgagctgttttggcgtcgcagaaagaacttgttctattccttggaaggctttgccgtggaagagcgtcttgccatcatagaggtcatgttcggtgcaggctgggtcaggagtgagatcaaagtcacgggtgatgacactgggacgtggagcaggggaaagcacgacagtcgccttgtaagcagggactgacttgccattgacttgagatttgagaagcacttgaaccttgaccttgaccttgccagcatcctcttgttcctcctttctccttgacaactcaaccctaaccggaacatcagctccattgtcaatggctatgcctttgaaaagctgggcatcctcaactgcccaaagctgatgtccagcgtagatgctctgagcttggtgagccatgtagccgacagccagtgtcatcggcaaaacccttctcccttgaatgacatgtgaatccaagaaggggttgtcgctctgacgaagagtctgcaaaacagtgtgctcagtggcacttggaaccacaggtggcactccccagttcccaacaaggagctgaccagggctggagctgacaagcatgttcgcaactgtctgtgctccaccttgacgagggataatctgaatgcccattctgatgaagttggccttgagtgcaggcgtcaccatccctccatcccacggaccaaagcaaatggatctcgcacaaagttggggatgcacagcagacagatgtgcagccagcttgttgagagcctcattggccattgcatagtcactctgaccaacattgccgtggaacccagcaagggagctgaagagcaccaggtgcctaagctgtgcaagatccacacaggcaaggaggttgatgagtccaccaacctttgtgtcatacacagcactgaaatcagccagtgacttgttctcaaccaacttgtctctcaaaacaccacttgcatgaaacacaccgctgacccttctccctccttgctgttgaaccctctcaaccatttcacgaaccttggctgcagagctgacatcacaggactcatagacagctgtggcaccttgagcagttatctctgccaggctcgcacggacctctctagctcccacaacagctccaacaagtttcttgtggagcatcggtgtcggcttcgctccccttccagctgcaaactcagctttgaggaacgccagcgcagccttctcaagaggtttccctgactcaacaccaacagcccaggcaggttccgtggtgggcagctcacttctcccaatgaggacataggttccacctcccaccctctgtgccaattctctcacacaaagaggtgtgattccacgagcacctccagagaccaggaacaaatcactggaagagatcggttgatgtggttttcccgtggtgagagactttgtggttgtggtgcatctttgcccagatgcggagtaaccagactccctcactgccacatctgggtctgaaagctcacccaaaagacatctggcagcttgtgcagcatccaagtcagctgcaaggtcgattcctctgcagaaaacagcaggccattccaagtcaagggttttgcagagtccaaagactgagccttgctgcgctctggagagatcaacagtggcagtcgtggactttccagacaaccccaactgaccatccaacctcgcaacggcaacaaagaaggtcctcccaccttctatctgttctgacaaggacgttttgagatgtttggcagcaagcagtgcccaaccaagctgcgcttggacatcgtcatcaccaaactggaacacaaaacctcccacttttccaaactgtgcttcaactgatgtgagcgcagcttgcaatgcagcttcagaacggtctgcaacagtgaccaacttgtgcgtggtgcttctgggtgaacaggcagagctggactgaacttgcaagagcacagcacgatcaccaagtgaggacacaagagaactggtgagtgcagagccatcgtcaaccacaaccacaggacgtgctccaccttcagccagcacaagttcagcaggaagaggcagggttgtgatgactgggaaagtcaagctcaaatcttcacactcagaaccaaacaaagttggaaggagggcaggtgctgacggagctgcaggagctgaacctccagaggcagcaactatctcagccttcatggcatcgaccacttctccaaccgttctggtccttgacaacgcatcgacatctttggcctcaacacccagctgaccttgaacctcagaaaggatttccacacgcttgatgctatcaatcccaagctcggcttccaagtccatgtcagcctcaaccatgtcagcctcgtagccagtcttggcagccaaaacagccatgacaacagtttcagcttttgaaaggagggcttgcaaatcagcactaggagcggtggctggcgtgggagctgcagaggctgctggtgcggacggaacggcagctgcaggtgctgaccctcctgacgctgccactatctcagccttcatggcatcaaccacctctcccaccgtccttgttctggaaagagcatcaacatctttggcctccaccccaagctgaccttgaacctcagagaggatttcaacacgtttgatggagtcaattccaagttcagcttccagatccatgtccgcttccaccatgtctgcctcatagccagttttcgcagcaaggactgccatcacaactgtctcagccttgctcaggagagcttgaaggtccgcacttggtgcagtagaggcagctggtgtgggagcggcggaggcagctggtgcgcttgggacagcgggtgcgggagcagaaccagcactggcagcaacaatctctgccttcatcgcatcaacgacctcaccaactgttctggtccttgagagggcatccacatccttcgcctccactccgagctgtccttggacttcactgagaatctcaacacgcttgatgctgtcaatgcccaattcagcctcaaggtccatgtcggcttccaccatatcagcctcatagccagttttcgcagccaggacagccatgacaactgtttcagccttcgcaagcaatgcctgcagatccgcactcggtgctgtggcagctgcaggagtcggagctgcgctggctgctggagctgacgggaccgcaggtgcaggtgcagatccaccgctggcagcgacaatctcagccttcatcgcatcgacaacttccccaacagttctggtcctactgagggcatcaacgtctttcgcttcaactccgagctgaccttgcacctcagagagtatctccactcttttgatggaatctattccaagttcggcttccaaatccatgtcagcttcaaccatgtcggcttcgtaaccagtctttgcagcaaggacagccatcacaactgtttcggctttggacagcaaggcttggaggtctgcagaaggagccgtggatgcagctggagttggagccgctgacgctgcaggtgcagaaggaactgctggagcaggagcggagccagcagaggcagccacaatctcagccttcatggcgtccacgacctcaccgacggttctggttcttgaaagcgcatcgacatctttggcttccacacccaactgtccttggacctcagacaagatttcaacacgtttgatgctatctattcccaactccgcttcaaggtccatgtcagcttccaccatgtcagcctcgtaaccagttttcgctgcgagcacagccatcacaaccgtctcggctttagacaggagagcctgaagatcagcactcggagcggtactcgcagcaggtgtcggagccgctgatgcagctggtgcagaggggacagcaggtgctgacccaccagatgcagcaacaatctcagccttcatggcatccacaacctctccgacggtccttgtacgtgaaagggcatcaacatccttcgcttcaactccgagctgcccttggacttcactcaggatctccacccttttgatggaatcaatcccaagctcagcctccaaatccatatctgcttccaccatgtctgcctcgtagccagtctttgcagccaaaactgccatcacgaccgtctcagctttcgccaggagtgcttggaggtcggctgatcctctggtggacttgctgtttccgctaactggtgaggatgttggtgtaggggaagaagtgggtgttggaacgactgttgccacgggaactgcttgctcatcacaatcttggagcatcctctggagcagttccttgtgtctcctaagcacttccgcagctgcattggagtcagagttctcacctttctcttgctgttgctgttgaaccttcctctccaagtcttggattgtcctctccaattcagcgaccttggattgagctgcttgggctgcagtgcttgcttcagcaagctgacgctggaggtcttgtgcttgtctgacaagtctctcttcgtttgcagtgtccacttctttgacaaccgctgtggcaccactcacagtgtaaccatcattgagcacagcctccctctgcctcaaggtcttggcagagacataggtggcagcactcaacctcaaggttgttttctttttcttgacaggctcaagacgagtggcatcgggaagctgccatctgtcaaagtctttgagtggaacaccagccacagccaaggtgagagctgcttgtctcagctgggtgtctgaatccttggctgagtctgggttgacagccaccgtgaccacgtctccagcttccccaagggtctctttgaccaaacgagaaaggacttgcttgggaccgaactcaacaaacacccttgctccagctgcgtgcatggcacggacttgctgcacaaactgcacaggagaagtcatgtgtttcccaaggttcgttttgacatcagcaggagaggtgactgcagctccaccagtgacgttgctgtagaatctggcagctgcaggtgcggacactggagcttgagcaagcgcagacgcaaatgtctgctctgctccacgcatgtgtggtgaatggaaggcagcttcacaagcaagaggaaccactctgaagtttccactacaacgaagtttgtcagatgcagctgccactgcttcagcagttcccgtgatcaccgtctgtgatggactgttgctattggccagccaaacatcaggtgctccaccaaggctgagctgatcagccttggctcctatgaccgctgccatagcacctccactggagctggcttgagcagtgaaatcagacatggcctttgccctagcgcaaaccaagtcaaacacagcatcacgatccaatgaaccagctgcatagagagctgcaaactctcccagggaatgtccagctgcaaaagaaggagccaatccagctgctttgaagatgtcaaaggcaccgacagagcaagcgagggttgctggctgagagtaacgcgtctgagaaatctctttgtgatcttgccttggctcatctccataaggttttctcggatagagaacactggagactcttttggctggcctcccaaaacgttctctctgcgctctgtccatcgcagcaacactctctctgaacggaggccagttcatggcaacatctgagaacatgtgagtgtactgcgctccttggccagagaaaagtgcagcaacattggcctctgtggcaacacccctaactctgaatgcagcctcaccagtggcaactgagaccgtccattccgttgctgactcttctccagcaagtttggctgcagctgcttccaaaaccgcaatgagagaggacaggtccctcaccagaagtccaacccttgcgtgggcttggggaacagctcctctcaacttacattcatcaaggaacctatggtatgcaatgtaatcagcgttcttcacaactctagcctcttcttgctcagcagtggccaatgccagttttgccctaactgtggcagcaagagttgcaacatccccagcatgaaggagagcaacttggggaagattgttgtaacggtaagcactctcatgttcaggttcaaactcttcaagcacagcatggtagttcgcacctccaaaaccaaatgaggaaacgccagctctcctcggaaccccaaccggagtgaaccagggacggttcatggtgttgacgtacaaaggggactgttgaatcggtgtcccatccaccagtgaaggtggcttgtccacattgatcgtctgaggcaatgtcttgtgcttgagagcaaggaccactttgaccaatccagccaatccagcaaccgctttgaggtgccctatctggctcttgatgctgccaacagcaacttgctcagcttcctcagctccacctccattcgcagaaaacgctttggagaagagattgctcagagctgtgagttcaatcttgtccccaaccggagtgccagttccatgtccttcaacaagagtgacagtggctgggtccacattggcacgtgcataggctctacggagagcctcttcttgtccgctgattgtcggtgtgtagattccagctgcttttccatcacttgaggaagcacagcccttgatgacagcatgaacagtgtcaccatctctgacagcatccgcatatctcttcagaacaagcatcgcagatccttcaccaatcaacatgcctttggtggcagcatcatacgctttgacactcgggtccgtagagaaaacaggcgtcttggagaaggccatgtacatccctattgaattgtctgtgcaggtggcaccagcaatcatggcatcacagtcaccatagagaagctcttctattgccaccttgaccgcaatcaggcttgaagcacaggcagcgtcaacgacacagttcatgccctccatgttgaaggtgttgcaacatctgccagcggtaacattgcccaagaaaccaggaaaagaatcaagcctccactctgggaagctcgccttgtacttgtccaccgcagctgccacatcttcctctggcaaacccatctttctgagcactttgtcaaccacaacatagttgagtctggagtagaactcatgtgacgccttctgacctccacctatgccaagaacacaaccaatgttctttttgccacttgagaaagcaggtatgttggcatcggtgagagcttccttcaccttgagcaatgagatggtctggttcgcatcagaatcttccatctggaacatgttgaggccaaactcacgagcatcaaagtcatactcagggatgaacccacctcttttgcagtagattttgtccttggtcgttttctctggattgtaataggcagtcacatccacacgatccgcaggcagatcagacagacaatccaagccatctctgatggcctcccagctctctctaacattctcaccactcggaaggatcgcactcattcccacaatggcaattctggtatccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagaaccggtgactactctacagccttggattaggcacggcatcgcgatctcttgggccgttgacttttaacttgcgatgacttttctaatttacgagtcaataaccattctccctcagatattgacttgttcgtagataagtgtcactttggaagctagcattacgagtacacgggtcggcaacttgcaaatcgtcgaaaattgctatgcaagttgatctctgatttggtagtacactcagctttgtgatcagccaatactcattacgtggtttattagcaaaatgaatcgacatgagccacagcgagtgacaccagttacgattccctcacaacctccgtctcgtgaaacgtaatagatcagcgttgtatgatgtaagatattgtagttttggatgtcaacgtagggtcgtgaagaggtttattaactcacatgttggaacccttagtgagttttcactttacaaatcacgcgtgccactacgtattacttcatcgtagatagggacaacacagaaacgaaagtgcgaaacctttacatcaccaggtcccaggcgagattcccaggggtgactaaaagtacgcatttgaaaactatgggggctattgaatctaaacatcagatagtcaccatgatcaatatccccgttacgcttgcttcgtaatctgggggagtagccgcttcccgcgcttacgagcgtgctcaagggccatacaaactgaccccagtgagccgttcagagtgcgtgccattgagaattggcgtacttctgttgaaaaaagtgcgataacgctcttcagggtggtcgataacccaagcgtagaatcacactttgcagaggatatgaggttcttaactaggatacttggggcgatcatcaagtaaggatgaagtcgcgtacgtactttctacatgctcagctaaagtgcaagcgggggacatgacgagatgattccaggaatcggggacattggcttagggcttatagatgtcttgttcgataacaccggtggatccccgggtaccgagctcgaattcctcgaccaacttttctatacaaagttgtctagacctaggactaggcactgagtgactcactgacctgactgagtgactggcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcagagtgcatgatctggtctgtaggtgaagaggtcatcttcagtgtccacatctatccttggtgcaagtttgacactgagcaatctctggagatacgcagcaccagacaggatttgaaggttgatctgcacaacatcagggaactcaccagagactgcaacatcaagatagctgtctgcaatgaaatcgttgaaggctcctatggcaggtccacaccaaatctggtaatccatcgtacggtcagctatgccattgtttgcccagaatgagctgagacccaagtaccaacggaagcagagggacatcttgagcttggggtcctcattctcagcctttctgatcttttcaggattgttgagacgagtgatgtagaaatctttggtctctgcccaaacttctgcaagggacttggagaagatcctcttctcaacacgagccaattcatccgcaggcattgcttcaaaggaatcatacttgtggaacagttcaaagagtttcttggcacgagatgggaacatcgttcctttcttgagaacttgcagttcaactccttgttcaaacatgtctgcagctggtgccatcgtgatgtcagagtaagtggcacgagagagctgacgcctcacgttgtcacatgttccagcttgacgggacagctggttgacagtgccagtcacaacaaacgcagctcccatgtggaaggctccaagtgcagcttgaggacaacctatgcctccaccagcaccaaccctaacacggtgtctggcagggtacttgagttccctctggagcctattcctcagactgaggatcaacggcagaatgacatgaatgggacggttgtcagtgtgccctccactgtcagcctcaactgcaatgtcatcagccattggaacttcaagagccaacgcagcttgctcaggggtgatttcaccagacgcaacaagtttgtccagaattgcttgaggtgcaggtctgatgaacatctccgcaagctctgttctggaaacctttcctatgatcttgtgtgctgtcctcactgagccacctctcgcatctctggagagtcccgtggctctgtaacggaccacttgtggtgtgagttccatgaaggcagacgcctcaaccacacgaactcccttttccaggaaaagatcaacattgcccttttccaggttggcatcgaacggtgagtggatgaggttgacagcatacggaccagcgggaagtgcagcttggatcttttcaatcccagcacggacaacgtgcattggcaacccaccagctccaaagctccccaacatcttcctctgacccattgctatgaccagatccgcagaggctattcccttggccatcgcaccactgtacaacggagcaaccaccccataagtctccatgaatccacggtctcccaaatcgctgacagcacaggctggcacctcacttccagcatccaactgcaatggtctctccagtgtcagcaacgcttgtttgagagcttgaagatcagccacatccacatcagcaatgctggagttctttgtggtggctttggcagcaacttcttgctcttcaacatggccagctccagtctggattctgaccctcaggttgtctgctgaatagactctgaggccatcaacgaagaggaacccatcagcaaccacatcaacccatgaggagaaggcagcaacactcttgatgtgaacttcactgtccattctgtcattctttggggtcaactgacctctgtacttccagctggtggcaccaggtgcatgtgcaaagactggatgagcaattccatgccttgcagccaagccttgtttgacacaccacgcttccacaagctggaacatggactcaattcccaaagacccaggcatcactgggtcaaaccagaaatggcaagaaaagaaccaatcttgcttgttcacagctttctccccatgagcataaccttggccatgcactccagctccactcccagcaagatgaattgtgtccaggaactgcgcttgtgaccctctcctctgaagctgaagctgaccttgggcactagaagctgacgcaggtgctgagagtgtgtccactgccacattgttttccctataccaaggcaacctcggcttgccattgtccaatccagtctggctctcaaagacctcaggaacaaaccaaccaaaagaggtgctccctttgtagaaaactgctccgtcaacagagagttcgaaggtgaaacgatggattcccatcttgccaagcatggagtatcccgtgcatttggtgaagttccttatggttttccctctgacatcaggcatggcatcacccacaagttctgcatctgcatcaaggtttctgaaaaggatgtcatctttgtccattgtgagcggagctttgagcacagatgtgaggactccagaagtctgaagagcaatctccatcaagatgctgtacggcatgtgatcgtctctgcttgaggctccaaagaaccaagcatctgcaggacaatcaaactcacccaccatcgtgccttggccagggttgacatccacattgtagaaaggaccatgttccatgtcagccacactcgtcacccttgtcacaagagccaggtcaaaagctggtgatctggatgtcttggaagcatcaaatctggcaaactcaggacccaagcagttgctcacttttccacacatgaactcagacatgttgaaccaggtcaacggcatttggccaggtgtatgatcattgtcaagcggattgttggggaaaggagagaagcaaacagctctgggaggatacgctgaaggagagaaggacggagtgggtccaggacctccatttccctcagccattggatgccacgtgacagaggtgggagcagtgggatcacctttgaggcatccacttggaggagcaatcactctgctggttgtcgtggtcgtagtggtgacagtcatgctctctttctgttgctccttccttttctgcagtgacaacgcaattcccttgaaatccacaactatctttttcctcaaatctccttggccatagctgtgaagatcctcaactccagcaaacgcttgtccctcttcaaagttgacatcaatgatgtcaacatcagctatggcaaatggatctccagttttggcatcaaagcccatttctttgatctccatgacataaacaagtttccccttgtgcggtgaaatctgtccacgacacctcactttgttggcatgaccactgactggacgaaagtcgaacgcaccaacagtggtgtgaaggccaagccacaacatgtaaaccttgagaagctgagagcatccatctgagacaagagaaccagccatgacctcatccctcacaaagtggcaggggaagtaccagtggtccctctcaagcactttctccccaatgagaagcccaagaccgtgagcacctccacgcggatcaaggtgtgtgactctgtcaatcatcagcatctttctcgcacacaacttgtagtctatgccagccattccagaaccaaagacccttgcccattgcctatcaacaagcagtctcatttctctggcatccaagctggttttgtgactgcacggtgcaggtgcaaagggtgcaatgtcttgtttctggatctgagcacgtgcagcaagctcagccttcgttttgagcacaccttttccagcggcaagttcggcatcagtaaagaagccagcacaaccatctctcatctctatgagcaatctgccatcaacaaagcagtcatactcgaaaaagaacattgagatttccccaccagcacccttggcgaaaccagtgactctgatgtcatacacaagggtttctccttcatgggcaaccccaaagaaggtgagagatgtgttgagcaatctgtaaacacggtcccctttgcactggaagtcaatccccatgtaggagatgagcatcaagtcacactgcccactttcaacaagaactgcccagggaacatcacctccctctgacaactcaccattgactggaacatcatactcagtgaccattctggagccaactctgaagttattcacctcggcatccatgagagtcactcttgaaacaagcaagtattctctggctggaagcctcacacgccttctgtacttgtcaatgatgtcaaactctggtccaaacacttgaccaacatcaccctccgcaaactccaacagctcgttgtagtcaaagacaaccgtcttgccatccaacagctcttccttgctcatttcccaaacaggagttttctttgaagatgtcatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgacacccagcttt

SEQ ID NO: 34 - DNA, 33995 bp, Artificial Sequence
  Plasmid pDAB112201
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctaggtcgacctcgaggctagcactagtttaattaagcggccgcacatcaatttgctgcgactggtcccgattccaagttgttgattcttaattatcccaagattttcgatttatgaataaacggcctgcctgattctaaaggctatatcaagttacaataaagggcctgattctatagtccacagaaggcccaataaaaatgatgactgccggttaatttctattggaaatttcttgaaactaccggttaagttaacttctctttattgaaattatgaaattgatattttcaaagacgttttttaatttccatatacggattcgatcaagcgtgctactttctgcgaaatagaccgcgtatctttgtgtttacagatatttacgatttaatatggataaaatggtttgttttgatcttctgtgaacaatacggataacgcgtgtagtacatgattgtccataacaatcaaaacggactgtttacccaggttcaatcgcaaatatctgtaaacacaggagtacattgatcttttttcgcggacaatgacaagcctataacatatccgtccgtagtattaatgttcacgctgaagctaaatggcagtatagacaagattggtaaacttaaatggcagtcctcctaaaaaaacttttatttcttatttataacgaaaagagaacatcttcaacatcaaaaaaaaaactaaaaaaaaaaaagaaacgttgacactaagatacattaagagctcggtgacctaagtgattaagctaactactcatcagtatgtgagtgtcttgttgaggacaacactggctctcgcagagaagtacacttcaccttgctcatcgtgcatggcaacagtgcatttgcacacagaatccaccaatggtgaagctgaagccagtttgacactggtatagtaagttgctccaggagccatcggtttgtagaaatcaaacctttcacagttattgggcagcgcagcagactgtctcaacatcctagcccaaacaagcatggcttggaaagcaatgtcagcttggaatgggtcttgctggctgagattgaccacaaactggccacgctgctccggtgtgagtggaaggtttctgcatttggcagtgagctgttttggcgtcgcagaaagaacttgttctattccttggaaggctttgccgtggaagagcgtcttgccatcatagaggtcatgttcggtgcaggctgggtcaggagtgagatcaaagtcacgggtgatgacactgggacgtggagcaggggaaagcacgacagtcgccttgtaagcagggactgacttgccattgacttgagatttgagaagcacttgaaccttgaccttgaccttgccagcatcctcttgttcctcctttctccttgacaactcaaccctaaccggaacatcagctccattgtcaatggctatgcctttgaaaagctgggcatcctcaactgcccaaagctgatgtccagcgtagatgctctgagcttggtgagccatgtagccgacagccagtgtcatcggcaaaacccttctcccttgaatgacatgtgaatccaagaaggggttgtcgctctgacgaagagtctgcaaaacagtgtgctcagtggcacttggaaccacaggtggcactccccagttcccaacaaggagctgaccagggctggagctgacaagcatgttcgcaactgtctgtgctccaccttgacgagggataatctgaatgcccattctgatgaagttggccttgagtgcaggcgtcaccatccctccatcccacggaccaaagcaaatggatctcgcacaaagttggggatgcacagcagacagatgtgcagccagcttgttgagagcctcattggccattgcatagtcactctgaccaacattgccgtggaacccagcaagggagctgaagagcaccaggtgcctaagctgtgcaagatccacacaggcaaggaggttgatgagtccaccaacctttgtgtcatacacagcactgaaatcagccagtgacttgttctcaaccaacttgtctctcaaaacaccacttgcatgaaacacaccgctgacccttctccctccttgctgttgaaccctctcaaccatttcacgaaccttggctgcagagctgacatcacaggactcatagacagctgtggcaccttgagcagttatctctgccaggctcgcacggacctctctagctcccacaacagctccaacaagtttcttgtggagcatcggtgtcggcttcgctccccttccagctgcaaactcagctttgaggaacgccagcgcagccttctcaagaggtttccctgactcaacaccaacagcccaggcaggttccgtggtgggcagctcacttctcccaatgaggacataggttccacctcccaccctctgtgccaattctctcacacaaagaggtgtgattccacgagcacctccagagaccaggaacaaatcactggaagagatcggttgatgtggttttcccgtggtgagagactttgtggttgtggtgcatctttgcccagatgcggagtaaccagactccctcactgccacatctgggtctgaaagctcacccaaaagacatctggcagcttgtgcagcatccaagtcagctgcaaggtcgattcctctgcagaaaacagcaggccattccaagtcaagggttttgcagagtccaaagactgagccttgctgcgctctggagagatcaacagtggcagtcgtggactttccagacaaccccaactgaccatccaacctcgcaacggcaacaaagaaggtcctcccaccttctatctgttctgacaaggacgttttgagatgtttggcagcaagcagtgcccaaccaagctgcgcttggacatcgtcatcaccaaactggaacacaaaacctcccacttttccaaactgtgcttcaactgatgtgagcgcagcttgcaatgcagcttcagaacggtctgcaacagtgaccaacttgtgcgtggtgcttctgggtgaacaggcagagctggactgaacttgcaagagcacagcacgatcaccaagtgaggacacaagagaactggtgagtgcagagccatcgtcaaccacaaccacaggacgtgctccaccttcagccagcacaagttcagcaggaagaggcagggttgtgatgactgggaaagtcaagctcaaatcttcacactcagaaccaaacaaagttggaaggagggcaggtgctgacggagctgcaggagctgaacctccagaggcagcaactatctcagccttcatggcatcgaccacttctccaaccgttctggtccttgacaacgcatcgacatctttggcctcaacacccagctgaccttgaacctcagaaaggatttccacacgcttgatgctatcaatcccaagctcggcttccaagtccatgtcagcctcaaccatgtcagcctcgtagccagtcttggcagccaaaacagccatgacaacagtttcagcttttgaaaggagggcttgcaaatcagcactaggagcggtggctggcgtgggagctgcagaggctgctggtgcggacggaacggcagctgcaggtgctgaccctcctgacgctgccactatctcagccttcatggcatcaaccacctctcccaccgtccttgttctggaaagagcatcaacatctttggcctccaccccaagctgaccttgaacctcagagaggatttcaacacgtttgatggagtcaattccaagttcagcttccagatccatgtccgcttccaccatgtctgcctcatagccagttttcgcagcaaggactgccatcacaactgtctcagccttgctcaggagagcttgaaggtccgcacttggtgcagtagaggcagctggtgtgggagcggcggaggcagctggtgcgcttgggacagcgggtgcgggagcagaaccagcactggcagcaacaatctctgccttcatcgcatcaacgacctcaccaactgttctggtccttgagagggcatccacatccttcgcctccactccgagctgtccttggacttcactgagaatctcaacacgcttgatgctgtcaatgcccaattcagcctcaaggtccatgtcggcttccaccatatcagcctcatagccagttttcgcagccaggacagccatgacaactgtttcagccttcgcaagcaatgcctgcagatccgcactcggtgctgtggcagctgcaggagtcggagctgcgctggctgctggagctgacgggaccgcaggtgcaggtgcagatccaccgctggcagcgacaatctcagccttcatcgcatcgacaacttccccaacagttctggtcctactgagggcatcaacgtctttcgcttcaactccgagctgaccttgcacctcagagagtatctccactcttttgatggaatctattccaagttcggcttccaaatccatgtcagcttcaaccatgtcggcttcgtaaccagtctttgcagcaaggacagccatcacaactgtttcggctttggacagcaaggcttggaggtctgcagaaggagccgtggatgcagctggagttggagccgctgacgctgcaggtgcagaaggaactgctggagcaggagcggagccagcagaggcagccacaatctcagccttcatggcgtccacgacctcaccgacggttctggttcttgaaagcgcatcgacatctttggcttccacacccaactgtccttggacctcagacaagatttcaacacgtttgatgctatctattcccaactccgcttcaaggtccatgtcagcttccaccatgtcagcctcgtaaccagttttcgctgcgagcacagccatcacaaccgtctcggctttagacaggagagcctgaagatcagcactcggagcggtactcgcagcaggtgtcggagccgctgatgcagctggtgcagaggggacagcaggtgctgacccaccagatgcagcaacaatctcagccttcatggcatccacaacctctccgacggtccttgtacgtgaaagggcatcaacatccttcgcttcaactccgagctgcccttggacttcactcaggatctccacccttttgatggaatcaatcccaagctcagcctccaaatccatatctgcttccaccatgtctgcctcgtagccagtctttgcagccaaaactgccatcacgaccgtctcagctttcgccaggagtgcttggaggtcggctgatcctctggtggacttgctgtttccgctaactggtgaggatgttggtgtaggggaagaagtgggtgttggaacgactgttgccacgggaactgcttgctcatcacaatcttggagcatcctctggagcagttccttgtgtctcctaagcacttccgcagctgcattggagtcagagttctcacctttctcttgctgttgctgttgaaccttcctctccaagtcttggattgtcctctccaattcagcgaccttggattgagctgcttgggctgcagtgcttgcttcagcaagctgacgctggaggtcttgtgcttgtctgacaagtctctcttcgtttgcagtgtccacttctttgacaaccgctgtggcaccactcacagtgtaaccatcattgagcacagcctccctctgcctcaaggtcttggcagagacataggtggcagcactcaacctcaaggttgttttctttttcttgacaggctcaagacgagtggcatcgggaagctgccatctgtcaaagtctttgagtggaacaccagccacagccaaggtgagagctgcttgtctcagctgggtgtctgaatccttggctgagtctgggttgacagccaccgtgaccacgtctccagcttccccaagggtctctttgaccaaacgagaaaggacttgcttgggaccgaactcaacaaacacccttgctccagctgcgtgcatggcacggacttgctgcacaaactgcacaggagaagtcatgtgtttcccaaggttcgttttgacatcagcaggagaggtgactgcagctccaccagtgacgttgctgtagaatctggcagctgcaggtgcggacactggagcttgagcaagcgcagacgcaaatgtctgctctgctccacgcatgtgtggtgaatggaaggcagcttcacaagcaagaggaaccactctgaagtttccactacaacgaagtttgtcagatgcagctgccactgcttcagcagttcccgtgatcaccgtctgtgatggactgttgctattggccagccaaacatcaggtgctccaccaaggctgagctgatcagccttggctcctatgaccgctgccatagcacctccactggagctggcttgagcagtgaaatcagacatggcctttgccctagcgcaaaccaagtcaaacacagcatcacgatccaatgaaccagctgcatagagagctgcaaactctcccagggaatgtccagctgcaaaagaaggagccaatccagctgctttgaagatgtcaaaggcaccgacagagcaagcgagggttgctggctgagagtaacgcgtctgagaaatctctttgtgatcttgccttggctcatctccataaggttttctcggatagagaacactggagactcttttggctggcctcccaaaacgttctctctgcgctctgtccatcgcagcaacactctctctgaacggaggccagttcatggcaacatctgagaacatgtgagtgtactgcgctccttggccagagaaaagtgcagcaacattggcctctgtggcaacacccctaactctgaatgcagcctcaccagtggcaactgagaccgtccattccgttgctgactcttctccagcaagtttggctgcagctgcttccaaaaccgcaatgagagaggacaggtccctcaccagaagtccaacccttgcgtgggcttggggaacagctcctctcaacttacattcatcaaggaacctatggtatgcaatgtaatcagcgttcttcacaactctagcctcttcttgctcagcagtggccaatgccagttttgccctaactgtggcagcaagagttgcaacatccccagcatgaaggagagcaacttggggaagattgttgtaacggtaagcactctcatgttcaggttcaaactcttcaagcacagcatggtagttcgcacctccaaaaccaaatgaggaaacgccagctctcctcggaaccccaaccggagtgaaccagggacggttcatggtgttgacgtacaaaggggactgttgaatcggtgtcccatccaccagtgaaggtggcttgtccacattgatcgtctgaggcaatgtcttgtgcttgagagcaaggaccactttgaccaatccagccaatccagcaaccgctttgaggtgccctatctggctcttgatgctgccaacagcaacttgctcagcttcctcagctccacctccattcgcagaaaacgctttggagaagagattgctcagagctgtgagttcaatcttgtccccaaccggagtgccagttccatgtccttcaacaagagtgacagtggctgggtccacattggcacgtgcataggctctacggagagcctcttcttgtccgctgattgtcggtgtgtagattccagctgcttttccatcacttgaggaagcacagcccttgatgacagcatgaacagtgtcaccatctctgacagcatccgcatatctcttcagaacaagcatcgcagatccttcaccaatcaacatgcctttggtggcagcatcatacgctttgacactcgggtccgtagagaaaacaggcgtcttggagaaggccatgtacatccctattgaattgtctgtgcaggtggcaccagcaatcatggcatcacagtcaccatagagaagctcttctattgccaccttgaccgcaatcaggcttgaagcacaggcagcgtcaacgacacagttcatgccctccatgttgaaggtgttgcaacatctgccagcggtaacattgcccaagaaaccaggaaaagaatcaagcctccactctgggaagctcgccttgtacttgtccaccgcagctgccacatcttcctctggcaaacccatctttctgagcactttgtcaaccacaacatagttgagtctggagtagaactcatgtgacgccttctgacctccacctatgccaagaacacaaccaatgttctttttgccacttgagaaagcaggtatgttggcatcggtgagagcttccttcaccttgagcaatgagatggtctggttcgcatcagaatcttccatctggaacatgttgaggccaaactcacgagcatcaaagtcatactcagggatgaacccacctcttttgcagtagattttgtccttggtcgttttctctggattgtaataggcagtcacatccacacgatccgcaggcagatcagacagacaatccaagccatctctgatggcctcccagctctctctaacattctcaccactcggaaggatcgcactcattcccacaatggcaattctggtatccatttttggttgtggatcctgttttgagtttgtgtcgggacagtagtaagagggtactaagggatgagatgtatttgtaaaggggtcttcgttttgtggtgcgttgctttcataaggcatgcatttagacatgtgtatactcactctcatgcatccatacacattgacataagttactagtctagttaaagttgccaaaataagagaaatagttggacaaaaaaagagtataaaaaataaatatacaaatattctttttctttttttaattaaaatcataaaatttctagagcaaattaataaaactgcccctaaaaaaaagataattcgaaaactacccccgttgacgattcaacgttttcgggggtagatgacgtcagatttttgtaaggttttcggaccacattaccccccttccgtcggatgttggacgcacgcgcttggtgtttttcctttgttgcgagtggtttttattaaccaaatacttggttgtctgattcgaacgtaactaaatataattcgagcaccattttgagtgggactaaatggattgaagctctatttccatttcacttggcccatttccgaattcgcggccgccctaggtctagatcgacacaactttgtatacaaaagttgtctagacctagggcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccttttagtattaagagaagaaccaaaggctttgttgttttcataatctttctgtcattttcttttattatgatgtcaagtcaagcgactctttggtagtaatctgtatgccatggatctctctctctatttgtcgactgaaaacttttgggttacacatgaaagctttttctttttctaaaatccaaaatgaaagagttgtattaacagatacataagtgaaagagtagtccctaagatgacactagcttcatttataaacaatcctatcacattgtatatacaggttatgatttattcccaatcagcgtcaaagaatccagcatctttcatctctgaatagtagacattctccaagtttagatcttcctcctcgatcaaagcggccgcttaattaaactagaaccggtgactactctacagccttggattaggcacggcatcgcgatctcttgggccgttgacttttaacttgcgatgacttttctaatttacgagtcaataaccattctccctcagatattgacttgttcgtagataagtgtcactttggaagctagcattacgagtacacgggtcggcaacttgcaaatcgtcgaaaattgctatgcaagttgatctctgatttggtagtacactcagctttgtgatcagccaatactcattacgtggtttattagcaaaatgaatcgacatgagccacagcgagtgacaccagttacgattccctcacaacctccgtctcgtgaaacgtaatagatcagcgttgtatgatgtaagatattgtagttttggatgtcaacgtagggtcgtgaagaggtttattaactcacatgttggaacccttagtgagttttcactttacaaatcacgcgtgccactacgtattacttcatcgtagatagggacaacacagaaacgaaagtgcgaaacctttacatcaccaggtcccaggcgagattcccaggggtgactaaaagtacgcatttgaaaactatgggggctattgaatctaaacatcagatagtcaccatgatcaatatccccgttacgcttgcttcgtaatctgggggagtagccgcttcccgcgcttacgagcgtgctcaagggccatacaaactgaccccagtgagccgttcagagtgcgtgccattgagaattggcgtacttctgttgaaaaaagtgcgataacgctcttcagggtggtcgataacccaagcgtagaatcacactttgcagaggatatgaggttcttaactaggatacttggggcgatcatcaagtaaggatgaagtcgcgtacgtactttctacatgctcagctaaagtgcaagcgggggacatgacgagatgattccaggaatcggggacattggcttagggcttatagatgtcttgttcgataacaccggtggatccccgggtaccgagctcgaattcctcgaggtcgaccaacttttctatacaaagttgtctaggtcgacctcgaggctagcactagtttaattaagcggccgcacatcaatttgctgcgactggtcccgattccaagttgttgattcttaattatcccaagattttcgatttatgaataaacggcctgcctgattctaaaggctatatcaagttacaataaagggcctgattctatagtccacagaaggcccaataaaaatgatgactgccggttaatttctattggaaatttcttgaaactaccggttaagttaacttctctttattgaaattatgaaattgatattttcaaagacgttttttaatttccatatacggattcgatcaagcgtgctactttctgcgaaatagaccgcgtatctttgtgtttacagatatttacgatttaatatggataaaatggtttgttttgatcttctgtgaacaatacggataacgcgtgtagtacatgattgtccataacaatcaaaacggactgtttacccaggttcaatcgcaaatatctgtaaacacaggagtacattgatcttttttcgcggacaatgacaagcctataacatatccgtccgtagtattaatgttcacgctgaagctaaatggcagtatagacaagattggtaaacttaaatggcagtcctcctaaaaaaacttttatttcttatttataacgaaaagagaacatcttcaacatcaaaaaaaaaactaaaaaaaaaaaagaaacgttgacactaagatacattaagagctcggtgacctaagtgattaagctaactactcagagtgcatgatctggtctgtaggtgaagaggtcatcttcagtgtccacatctatccttggtgcaagtttgacactgagcaatctctggagatacgcagcaccagacaggatttgaaggttgatctgcacaacatcagggaactcaccagagactgcaacatcaagatagctgtctgcaatgaaatcgttgaaggctcctatggcaggtccacaccaaatctggtaatccatcgtacggtcagctatgccattgtttgcccagaatgagctgagacccaagtaccaacggaagcagagggacatcttgagcttggggtcctcattctcagcctttctgatcttttcaggattgttgagacgagtgatgtagaaatctttggtctctgcccaaacttctgcaagggacttggagaagatcctcttctcaacacgagccaattcatccgcaggcattgcttcaaaggaatcatacttgtggaacagttcaaagagtttcttggcacgagatgggaacatcgttcctttcttgagaacttgcagttcaactccttgttcaaacatgtctgcagctggtgccatcgtgatgtcagagtaagtggcacgagagagctgacgcctcacgttgtcacatgttccagcttgacgggacagctggttgacagtgccagtcacaacaaacgcagctcccatgtggaaggctccaagtgcagcttgaggacaacctatgcctccaccagcaccaaccctaacacggtgtctggcagggtacttgagttccctctggagcctattcctcagactgaggatcaacggcagaatgacatgaatgggacggttgtcagtgtgccctccactgtcagcctcaactgcaatgtcatcagccattggaacttcaagagccaacgcagcttgctcaggggtgatttcaccagacgcaacaagtttgtccagaattgcttgaggtgcaggtctgatgaacatctccgcaagctctgttctggaaacctttcctatgatcttgtgtgctgtcctcactgagccacctctcgcatctctggagagtcccgtggctctgtaacggaccacttgtggtgtgagttccatgaaggcagacgcctcaaccacacgaactcccttttccaggaaaagatcaacattgcccttttccaggttggcatcgaacggtgagtggatgaggttgacagcatacggaccagcgggaagtgcagcttggatcttttcaatcccagcacggacaacgtgcattggcaacccaccagctccaaagctccccaacatcttcctctgacccattgctatgaccagatccgcagaggctattcccttggccatcgcaccactgtacaacggagcaaccaccccataagtctccatgaatccacggtctcccaaatcgctgacagcacaggctggcacctcacttccagcatccaactgcaatggtctctccagtgtcagcaacgcttgtttgagagcttgaagatcagccacatccacatcagcaatgctggagttctttgtggtggctttggcagcaacttcttgctcttcaacatggccagctccagtctggattctgaccctcaggttgtctgctgaatagactctgaggccatcaacgaagaggaacccatcagcaaccacatcaacccatgaggagaaggcagcaacactcttgatgtgaacttcactgtccattctgtcattctttggggtcaactgacctctgtacttccagctggtggcaccaggtgcatgtgcaaagactggatgagcaattccatgccttgcagccaagccttgtttgacacaccacgcttccacaagctggaacatggactcaattcccaaagacccaggcatcactgggtcaaaccagaaatggcaagaaaagaaccaatcttgcttgttcacagctttctccccatgagcataaccttggccatgcactccagctccactcccagcaagatgaattgtgtccaggaactgcgcttgtgaccctctcctctgaagctgaagctgaccttgggcactagaagctgacgcaggtgctgagagtgtgtccactgccacattgttttccctataccaaggcaacctcggcttgccattgtccaatccagtctggctctcaaagacctcaggaacaaaccaaccaaaagaggtgctccctttgtagaaaactgctccgtcaacagagagttcgaaggtgaaacgatggattcccatcttgccaagcatggagtatcccgtgcatttggtgaagttccttatggttttccctctgacatcaggcatggcatcacccacaagttctgcatctgcatcaaggtttctgaaaaggatgtcatctttgtccattgtgagcggagctttgagcacagatgtgaggactccagaagtctgaagagcaatctccatcaagatgctgtacggcatgtgatcgtctctgcttgaggctccaaagaaccaagcatctgcaggacaatcaaactcacccaccatcgtgccttggccagggttgacatccacattgtagaaaggaccatgttccatgtcagccacactcgtcacccttgtcacaagagccaggtcaaaagctggtgatctggatgtcttggaagcatcaaatctggcaaactcaggacccaagcagttgctcacttttccacacatgaactcagacatgttgaaccaggtcaacggcatttggccaggtgtatgatcattgtcaagcggattgttggggaaaggagagaagcaaacagctctgggaggatacgctgaaggagagaaggacggagtgggtccaggacctccatttccctcagccattggatgccacgtgacagaggtgggagcagtgggatcacctttgaggcatccacttggaggagcaatcactctgctggttgtcgtggtcgtagtggtgacagtcatgctctctttctgttgctccttccttttctgcagtgacaacgcaattcccttgaaatccacaactatctttttcctcaaatctccttggccatagctgtgaagatcctcaactccagcaaacgcttgtccctcttcaaagttgacatcaatgatgtcaacatcagctatggcaaatggatctccagttttggcatcaaagcccatttctttgatctccatgacataaacaagtttccccttgtgcggtgaaatctgtccacgacacctcactttgttggcatgaccactgactggacgaaagtcgaacgcaccaacagtggtgtgaaggccaagccacaacatgtaaaccttgagaagctgagagcatccatctgagacaagagaaccagccatgacctcatccctcacaaagtggcaggggaagtaccagtggtccctctcaagcactttctccccaatgagaagcccaagaccgtgagcacctccacgcggatcaaggtgtgtgactctgtcaatcatcagcatctttctcgcacacaacttgtagtctatgccagccattccagaaccaaagacccttgcccattgcctatcaacaagcagtctcatttctctggcatccaagctggttttgtgactgcacggtgcaggtgcaaagggtgcaatgtcttgtttctggatctgagcacgtgcagcaagctcagccttcgttttgagcacaccttttccagcggcaagttcggcatcagtaaagaagccagcacaaccatctctcatctctatgagcaatctgccatcaacaaagcagtcatactcgaaaaagaacattgagatttccccaccagcacccttggcgaaaccagtgactctgatgtcatacacaagggtttctccttcatgggcaaccccaaagaaggtgagagatgtgttgagcaatctgtaaacacggtcccctttgcactggaagtcaatccccatgtaggagatgagcatcaagtcacactgcccactttcaacaagaactgcccagggaacatcacctccctctgacaactcaccattgactggaacatcatactcagtgaccattctggagccaactctgaagttattcacctcggcatccatgagagtcactcttgaaacaagcaagtattctctggctggaagcctcacacgccttctgtacttgtcaatgatgtcaaactctggtccaaacacttgaccaacatcaccctccgcaaactccaacagctcgttgtagtcaaagacaaccgtcttgccatccaacagctcttccttgctcatttcccaaacaggagttttctttgaagatgtcatttttggttgtggatcctgttttgagtttgtgtcgggacagtagtaagagggtactaagggatgagatgtatttgtaaaggggtcttcgttttgtggtgcgttgctttcataaggcatgcatttagacatgtgtatactcactctcatgcatccatacacattgacataagttactagtctagttaaagttgccaaaataagagaaatagttggacaaaaaaagagtataaaaaataaatatacaaatattctttttctttttttaattaaaatcataaaatttctagagcaaattaataaaactgcccctaaaaaaaagataattcgaaaactacccccgttgacgattcaacgttttcgggggtagatgacgtcagatttttgtaaggttttcggaccacattaccccccttccgtcggatgttggacgcacgcgcttggtgtttttcctttgttgcgagtggtttttattaaccaaatacttggttgtctgattcgaacgtaactaaatataattcgagcaccattttgagtgggactaaatggattgaagctctatttccatttcacttggcccatttccgaattcgcggccgccctaggtctagatcgacacaactttgtataataaagttgtctagacctagggcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcacccttttagtattaagagaagaaccaaaggctttgttgttttcataatctttctgtcattttcttttattatgatgtcaagtcaagcgactctttggtagtaatctgtatgccatggatctctctctctatttgtcgactgaaaacttttgggttacacatgaaagctttttctttttctaaaatccaaaatgaaagagttgtattaacagatacataagtgaaagagtagtccctaagatgacactagcttcatttataaacaatcctatcacattgtatatacaggttatgatttattcccaatcagcgtcaaagaatccagcatctttcatctctgaatagtagacattctccaagtttagatcttcctcctcgatcaaagcggccgcttaattaaactagtgctagcctcgaggtcgacacccagcttt

SEQ ID NO: 35 - DNA, 38249 bp, Artificial Sequence
  Plasmid pDAB112203
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctaggtcgacctcgaggctagcactagtttaattaagcggccgcgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactgagctcggtgacctaagtgattaagctaactactcatcagtatgtgagtgtcttgttgaggacaacactggctctcgcagagaagtacacttcaccttgctcatcgtgcatggcaacagtgcatttgcacacagaatccaccaatggtgaagctgaagccagtttgacactggtatagtaagttgctccaggagccatcggtttgtagaaatcaaacctttcacagttattgggcagcgcagcagactgtctcaacatcctagcccaaacaagcatggcttggaaagcaatgtcagcttggaatgggtcttgctggctgagattgaccacaaactggccacgctgctccggtgtgagtggaaggtttctgcatttggcagtgagctgttttggcgtcgcagaaagaacttgttctattccttggaaggctttgccgtggaagagcgtcttgccatcatagaggtcatgttcggtgcaggctgggtcaggagtgagatcaaagtcacgggtgatgacactgggacgtggagcaggggaaagcacgacagtcgccttgtaagcagggactgacttgccattgacttgagatttgagaagcacttgaaccttgaccttgaccttgccagcatcctcttgttcctcctttctccttgacaactcaaccctaaccggaacatcagctccattgtcaatggctatgcctttgaaaagctgggcatcctcaactgcccaaagctgatgtccagcgtagatgctctgagcttggtgagccatgtagccgacagccagtgtcatcggcaaaacccttctcccttgaatgacatgtgaatccaagaaggggttgtcgctctgacgaagagtctgcaaaacagtgtgctcagtggcacttggaaccacaggtggcactccccagttcccaacaaggagctgaccagggctggagctgacaagcatgttcgcaactgtctgtgctccaccttgacgagggataatctgaatgcccattctgatgaagttggccttgagtgcaggcgtcaccatccctccatcccacggaccaaagcaaatggatctcgcacaaagttggggatgcacagcagacagatgtgcagccagcttgttgagagcctcattggccattgcatagtcactctgaccaacattgccgtggaacccagcaagggagctgaagagcaccaggtgcctaagctgtgcaagatccacacaggcaaggaggttgatgagtccaccaacctttgtgtcatacacagcactgaaatcagccagtgacttgttctcaaccaacttgtctctcaaaacaccacttgcatgaaacacaccgctgacccttctccctccttgctgttgaaccctctcaaccatttcacgaaccttggctgcagagctgacatcacaggactcatagacagctgtggcaccttgagcagttatctctgccaggctcgcacggacctctctagctcccacaacagctccaacaagtttcttgtggagcatcggtgtcggcttcgctccccttccagctgcaaactcagctttgaggaacgccagcgcagccttctcaagaggtttccctgactcaacaccaacagcccaggcaggttccgtggtgggcagctcacttctcccaatgaggacataggttccacctcccaccctctgtgccaattctctcacacaaagaggtgtgattccacgagcacctccagagaccaggaacaaatcactggaagagatcggttgatgtggttttcccgtggtgagagactttgtggttgtggtgcatctttgcccagatgcggagtaaccagactccctcactgccacatctgggtctgaaagctcacccaaaagacatctggcagcttgtgcagcatccaagtcagctgcaaggtcgattcctctgcagaaaacagcaggccattccaagtcaagggttttgcagagtccaaagactgagccttgctgcgctctggagagatcaacagtggcagtcgtggactttccagacaaccccaactgaccatccaacctcgcaacggcaacaaagaaggtcctcccaccttctatctgttctgacaaggacgttttgagatgtttggcagcaagcagtgcccaaccaagctgcgcttggacatcgtcatcaccaaactggaacacaaaacctcccacttttccaaactgtgcttcaactgatgtgagcgcagcttgcaatgcagcttcagaacggtctgcaacagtgaccaacttgtgcgtggtgcttctgggtgaacaggcagagctggactgaacttgcaagagcacagcacgatcaccaagtgaggacacaagagaactggtgagtgcagagccatcgtcaaccacaaccacaggacgtgctccaccttcagccagcacaagttcagcaggaagaggcagggttgtgatgactgggaaagtcaagctcaaatcttcacactcagaaccaaacaaagttggaaggagggcaggtgctgacggagctgcaggagctgaacctccagaggcagcaactatctcagccttcatggcatcgaccacttctccaaccgttctggtccttgacaacgcatcgacatctttggcctcaacacccagctgaccttgaacctcagaaaggatttccacacgcttgatgctatcaatcccaagctcggcttccaagtccatgtcagcctcaaccatgtcagcctcgtagccagtcttggcagccaaaacagccatgacaacagtttcagcttttgaaaggagggcttgcaaatcagcactaggagcggtggctggcgtgggagctgcagaggctgctggtgcggacggaacggcagctgcaggtgctgaccctcctgacgctgccactatctcagccttcatggcatcaaccacctctcccaccgtccttgttctggaaagagcatcaacatctttggcctccaccccaagctgaccttgaacctcagagaggatttcaacacgtttgatggagtcaattccaagttcagcttccagatccatgtccgcttccaccatgtctgcctcatagccagttttcgcagcaaggactgccatcacaactgtctcagccttgctcaggagagcttgaaggtccgcacttggtgcagtagaggcagctggtgtgggagcggcggaggcagctggtgcgcttgggacagcgggtgcgggagcagaaccagcactggcagcaacaatctctgccttcatcgcatcaacgacctcaccaactgttctggtccttgagagggcatccacatccttcgcctccactccgagctgtccttggacttcactgagaatctcaacacgcttgatgctgtcaatgcccaattcagcctcaaggtccatgtcggcttccaccatatcagcctcatagccagttttcgcagccaggacagccatgacaactgtttcagccttcgcaagcaatgcctgcagatccgcactcggtgctgtggcagctgcaggagtcggagctgcgctggctgctggagctgacgggaccgcaggtgcaggtgcagatccaccgctggcagcgacaatctcagccttcatcgcatcgacaacttccccaacagttctggtcctactgagggcatcaacgtctttcgcttcaactccgagctgaccttgcacctcagagagtatctccactcttttgatggaatctattccaagttcggcttccaaatccatgtcagcttcaaccatgtcggcttcgtaaccagtctttgcagcaaggacagccatcacaactgtttcggctttggacagcaaggcttggaggtctgcagaaggagccgtggatgcagctggagttggagccgctgacgctgcaggtgcagaaggaactgctggagcaggagcggagccagcagaggcagccacaatctcagccttcatggcgtccacgacctcaccgacggttctggttcttgaaagcgcatcgacatctttggcttccacacccaactgtccttggacctcagacaagatttcaacacgtttgatgctatctattcccaactccgcttcaaggtccatgtcagcttccaccatgtcagcctcgtaaccagttttcgctgcgagcacagccatcacaaccgtctcggctttagacaggagagcctgaagatcagcactcggagcggtactcgcagcaggtgtcggagccgctgatgcagctggtgcagaggggacagcaggtgctgacccaccagatgcagcaacaatctcagccttcatggcatccacaacctctccgacggtccttgtacgtgaaagggcatcaacatccttcgcttcaactccgagctgcccttggacttcactcaggatctccacccttttgatggaatcaatcccaagctcagcctccaaatccatatctgcttccaccatgtctgcctcgtagccagtctttgcagccaaaactgccatcacgaccgtctcagctttcgccaggagtgcttggaggtcggctgatcctctggtggacttgctgtttccgctaactggtgaggatgttggtgtaggggaagaagtgggtgttggaacgactgttgccacgggaactgcttgctcatcacaatcttggagcatcctctggagcagttccttgtgtctcctaagcacttccgcagctgcattggagtcagagttctcacctttctcttgctgttgctgttgaaccttcctctccaagtcttggattgtcctctccaattcagcgaccttggattgagctgcttgggctgcagtgcttgcttcagcaagctgacgctggaggtcttgtgcttgtctgacaagtctctcttcgtttgcagtgtccacttctttgacaaccgctgtggcaccactcacagtgtaaccatcattgagcacagcctccctctgcctcaaggtcttggcagagacataggtggcagcactcaacctcaaggttgttttctttttcttgacaggctcaagacgagtggcatcgggaagctgccatctgtcaaagtctttgagtggaacaccagccacagccaaggtgagagctgcttgtctcagctgggtgtctgaatccttggctgagtctgggttgacagccaccgtgaccacgtctccagcttccccaagggtctctttgaccaaacgagaaaggacttgcttgggaccgaactcaacaaacacccttgctccagctgcgtgcatggcacggacttgctgcacaaactgcacaggagaagtcatgtgtttcccaaggttcgttttgacatcagcaggagaggtgactgcagctccaccagtgacgttgctgtagaatctggcagctgcaggtgcggacactggagcttgagcaagcgcagacgcaaatgtctgctctgctccacgcatgtgtggtgaatggaaggcagcttcacaagcaagaggaaccactctgaagtttccactacaacgaagtttgtcagatgcagctgccactgcttcagcagttcccgtgatcaccgtctgtgatggactgttgctattggccagccaaacatcaggtgctccaccaaggctgagctgatcagccttggctcctatgaccgctgccatagcacctccactggagctggcttgagcagtgaaatcagacatggcctttgccctagcgcaaaccaagtcaaacacagcatcacgatccaatgaaccagctgcatagagagctgcaaactctcccagggaatgtccagctgcaaaagaaggagccaatccagctgctttgaagatgtcaaaggcaccgacagagcaagcgagggttgctggctgagagtaacgcgtctgagaaatctctttgtgatcttgccttggctcatctccataaggttttctcggatagagaacactggagactcttttggctggcctcccaaaacgttctctctgcgctctgtccatcgcagcaacactctctctgaacggaggccagttcatggcaacatctgagaacatgtgagtgtactgcgctccttggccagagaaaagtgcagcaacattggcctctgtggcaacacccctaactctgaatgcagcctcaccagtggcaactgagaccgtccattccgttgctgactcttctccagcaagtttggctgcagctgcttccaaaaccgcaatgagagaggacaggtccctcaccagaagtccaacccttgcgtgggcttggggaacagctcctctcaacttacattcatcaaggaacctatggtatgcaatgtaatcagcgttcttcacaactctagcctcttcttgctcagcagtggccaatgccagttttgccctaactgtggcagcaagagttgcaacatccccagcatgaaggagagcaacttggggaagattgttgtaacggtaagcactctcatgttcaggttcaaactcttcaagcacagcatggtagttcgcacctccaaaaccaaatgaggaaacgccagctctcctcggaaccccaaccggagtgaaccagggacggttcatggtgttgacgtacaaaggggactgttgaatcggtgtcccatccaccagtgaaggtggcttgtccacattgatcgtctgaggcaatgtcttgtgcttgagagcaaggaccactttgaccaatccagccaatccagcaaccgctttgaggtgccctatctggctcttgatgctgccaacagcaacttgctcagcttcctcagctccacctccattcgcagaaaacgctttggagaagagattgctcagagctgtgagttcaatcttgtccccaaccggagtgccagttccatgtccttcaacaagagtgacagtggctgggtccacattggcacgtgcataggctctacggagagcctcttcttgtccgctgattgtcggtgtgtagattccagctgcttttccatcacttgaggaagcacagcccttgatgacagcatgaacagtgtcaccatctctgacagcatccgcatatctcttcagaacaagcatcgcagatccttcaccaatcaacatgcctttggtggcagcatcatacgctttgacactcgggtccgtagagaaaacaggcgtcttggagaaggccatgtacatccctattgaattgtctgtgcaggtggcaccagcaatcatggcatcacagtcaccatagagaagctcttctattgccaccttgaccgcaatcaggcttgaagcacaggcagcgtcaacgacacagttcatgccctccatgttgaaggtgttgcaacatctgccagcggtaacattgcccaagaaaccaggaaaagaatcaagcctccactctgggaagctcgccttgtacttgtccaccgcagctgccacatcttcctctggcaaacccatctttctgagcactttgtcaaccacaacatagttgagtctggagtagaactcatgtgacgccttctgacctccacctatgccaagaacacaaccaatgttctttttgccacttgagaaagcaggtatgttggcatcggtgagagcttccttcaccttgagcaatgagatggtctggttcgcatcagaatcttccatctggaacatgttgaggccaaactcacgagcatcaaagtcatactcagggatgaacccacctcttttgcagtagattttgtccttggtcgttttctctggattgtaataggcagtcacatccacacgatccgcaggcagatcagacagacaatccaagccatctctgatggcctcccagctctctctaacattctcaccactcggaaggatcgcactcattcccacaatggcaattctggtatccatttttggttgtggatccaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctgcggccgccctaggtctagatcgacacaactttgtatacaaaagttgtctagacctagggcggccgctcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagtaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccgagctcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtacggatccgtcgacgcggccgcttaattaaactagtgctagcctcgaggaattcgagctcggtacccggggatccaccggtgttatcgaacaagacatctataagccctaagccaatgtccccgattcctggaatcatctcgtcatgtcccccgcttgcactttagctgagcatgtagaaagtacgtacgcgacttcatccttacttgatgatcgccccaagtatcctagttaagaacctcatatcctctgcaaagtgtgattctacgcttgggttatcgaccaccctgaagagcgttatcgcacttttttcaacagaagtacgccaattctcaatggcacgcactctgaacggctcactggggtcagtttgtatggcccttgagcacgctcgtaagcgcgggaagcggctactcccccagattacgaagcaagcgtaacggggatattgatcatggtgactatctgatgtttagattcaatagcccccatagttttcaaatgcgtacttttagtcacccctgggaatctcgcctgggacctggtgatgtaaaggtttcgcactttcgtttctgtgttgtccctatctacgatgaagtaatacgtagtggcacgcgtgatttgtaaagtgaaaactcactaagggttccaacatgtgagttaataaacctcttcacgaccctacgttgacatccaaaactacaatatcttacatcatacaacgctgatctattacgtttcacgagacggaggttgtgagggaatcgtaactggtgtcactcgctgtggctcatgtcgattcattttgctaataaaccacgtaatgagtattggctgatcacaaagctgagtgtactaccaaatcagagatcaacttgcatagcaattttcgacgatttgcaagttgccgacccgtgtactcgtaatgctagcttccaaagtgacacttatctacgaacaagtcaatatctgagggagaatggttattgactcgtaaattagaaaagtcatcgcaagttaaaagtcaacggcccaagagatcgcgatgccgtgcctaatccaaggctgtagagtagtcaccggttctagagtcgaggtcgaccaacttttctatacaaagttgtctaggtcgacctcgaggctagcactagtttaattaagcggccgcgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactgagctcggtgacctaagtgattaagctaactactcagagtgcatgatctggtctgtaggtgaagaggtcatcttcagtgtccacatctatccttggtgcaagtttgacactgagcaatctctggagatacgcagcaccagacaggatttgaaggttgatctgcacaacatcagggaactcaccagagactgcaacatcaagatagctgtctgcaatgaaatcgttgaaggctcctatggcaggtccacaccaaatctggtaatccatcgtacggtcagctatgccattgtttgcccagaatgagctgagacccaagtaccaacggaagcagagggacatcttgagcttggggtcctcattctcagcctttctgatcttttcaggattgttgagacgagtgatgtagaaatctttggtctctgcccaaacttctgcaagggacttggagaagatcctcttctcaacacgagccaattcatccgcaggcattgcttcaaaggaatcatacttgtggaacagttcaaagagtttcttggcacgagatgggaacatcgttcctttcttgagaacttgcagttcaactccttgttcaaacatgtctgcagctggtgccatcgtgatgtcagagtaagtggcacgagagagctgacgcctcacgttgtcacatgttccagcttgacgggacagctggttgacagtgccagtcacaacaaacgcagctcccatgtggaaggctccaagtgcagcttgaggacaacctatgcctccaccagcaccaaccctaacacggtgtctggcagggtacttgagttccctctggagcctattcctcagactgaggatcaacggcagaatgacatgaatgggacggttgtcagtgtgccctccactgtcagcctcaactgcaatgtcatcagccattggaacttcaagagccaacgcagcttgctcaggggtgatttcaccagacgcaacaagtttgtccagaattgcttgaggtgcaggtctgatgaacatctccgcaagctctgttctggaaacctttcctatgatcttgtgtgctgtcctcactgagccacctctcgcatctctggagagtcccgtggctctgtaacggaccacttgtggtgtgagttccatgaaggcagacgcctcaaccacacgaactcccttttccaggaaaagatcaacattgcccttttccaggttggcatcgaacggtgagtggatgaggttgacagcatacggaccagcgggaagtgcagcttggatcttttcaatcccagcacggacaacgtgcattggcaacccaccagctccaaagctccccaacatcttcctctgacccattgctatgaccagatccgcagaggctattcccttggccatcgcaccactgtacaacggagcaaccaccccataagtctccatgaatccacggtctcccaaatcgctgacagcacaggctggcacctcacttccagcatccaactgcaatggtctctccagtgtcagcaacgcttgtttgagagcttgaagatcagccacatccacatcagcaatgctggagttctttgtggtggctttggcagcaacttcttgctcttcaacatggccagctccagtctggattctgaccctcaggttgtctgctgaatagactctgaggccatcaacgaagaggaacccatcagcaaccacatcaacccatgaggagaaggcagcaacactcttgatgtgaacttcactgtccattctgtcattctttggggtcaactgacctctgtacttccagctggtggcaccaggtgcatgtgcaaagactggatgagcaattccatgccttgcagccaagccttgtttgacacaccacgcttccacaagctggaacatggactcaattcccaaagacccaggcatcactgggtcaaaccagaaatggcaagaaaagaaccaatcttgcttgttcacagctttctccccatgagcataaccttggccatgcactccagctccactcccagcaagatgaattgtgtccaggaactgcgcttgtgaccctctcctctgaagctgaagctgaccttgggcactagaagctgacgcaggtgctgagagtgtgtccactgccacattgttttccctataccaaggcaacctcggcttgccattgtccaatccagtctggctctcaaagacctcaggaacaaaccaaccaaaagaggtgctccctttgtagaaaactgctccgtcaacagagagttcgaaggtgaaacgatggattcccatcttgccaagcatggagtatcccgtgcatttggtgaagttccttatggttttccctctgacatcaggcatggcatcacccacaagttctgcatctgcatcaaggtttctgaaaaggatgtcatctttgtccattgtgagcggagctttgagcacagatgtgaggactccagaagtctgaagagcaatctccatcaagatgctgtacggcatgtgatcgtctctgcttgaggctccaaagaaccaagcatctgcaggacaatcaaactcacccaccatcgtgccttggccagggttgacatccacattgtagaaaggaccatgttccatgtcagccacactcgtcacccttgtcacaagagccaggtcaaaagctggtgatctggatgtcttggaagcatcaaatctggcaaactcaggacccaagcagttgctcacttttccacacatgaactcagacatgttgaaccaggtcaacggcatttggccaggtgtatgatcattgtcaagcggattgttggggaaaggagagaagcaaacagctctgggaggatacgctgaaggagagaaggacggagtgggtccaggacctccatttccctcagccattggatgccacgtgacagaggtgggagcagtgggatcacctttgaggcatccacttggaggagcaatcactctgctggttgtcgtggtcgtagtggtgacagtcatgctctctttctgttgctccttccttttctgcagtgacaacgcaattcccttgaaatccacaactatctttttcctcaaatctccttggccatagctgtgaagatcctcaactccagcaaacgcttgtccctcttcaaagttgacatcaatgatgtcaacatcagctatggcaaatggatctccagttttggcatcaaagcccatttctttgatctccatgacataaacaagtttccccttgtgcggtgaaatctgtccacgacacctcactttgttggcatgaccactgactggacgaaagtcgaacgcaccaacagtggtgtgaaggccaagccacaacatgtaaaccttgagaagctgagagcatccatctgagacaagagaaccagccatgacctcatccctcacaaagtggcaggggaagtaccagtggtccctctcaagcactttctccccaatgagaagcccaagaccgtgagcacctccacgcggatcaaggtgtgtgactctgtcaatcatcagcatctttctcgcacacaacttgtagtctatgccagccattccagaaccaaagacccttgcccattgcctatcaacaagcagtctcatttctctggcatccaagctggttttgtgactgcacggtgcaggtgcaaagggtgcaatgtcttgtttctggatctgagcacgtgcagcaagctcagccttcgttttgagcacaccttttccagcggcaagttcggcatcagtaaagaagccagcacaaccatctctcatctctatgagcaatctgccatcaacaaagcagtcatactcgaaaaagaacattgagatttccccaccagcacccttggcgaaaccagtgactctgatgtcatacacaagggtttctccttcatgggcaaccccaaagaaggtgagagatgtgttgagcaatctgtaaacacggtcccctttgcactggaagtcaatccccatgtaggagatgagcatcaagtcacactgcccactttcaacaagaactgcccagggaacatcacctccctctgacaactcaccattgactggaacatcatactcagtgaccattctggagccaactctgaagttattcacctcggcatccatgagagtcactcttgaaacaagcaagtattctctggctggaagcctcacacgccttctgtacttgtcaatgatgtcaaactctggtccaaacacttgaccaacatcaccctccgcaaactccaacagctcgttgtagtcaaagacaaccgtcttgccatccaacagctcttccttgctcatttcccaaacaggagttttctttgaagatgtcatttttggttgtggatccaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctgcggccgccctaggtctagatcgacacaactttgtataataaagttgtctagacctagggcggccgctcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagtaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcaccgagctcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtacggatccgtcgacgcggccgcttaattaaactagtgctagcctcgaggtcgacacccagcttt

SEQ ID NO: 36 - DNA, 36011 bp, Artificial Sequence
  Plasmid pDAB112205
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcatcagtatgtgagtgtcttgttgaggacaacactggctctcgcagagaagtacacttcaccttgctcatcgtgcatggcaacagtgcatttgcacacagaatccaccaatggtgaagctgaagccagtttgacactggtatagtaagttgctccaggagccatcggtttgtagaaatcaaacctttcacagttattgggcagcgcagcagactgtctcaacatcctagcccaaacaagcatggcttggaaagcaatgtcagcttggaatgggtcttgctggctgagattgaccacaaactggccacgctgctccggtgtgagtggaaggtttctgcatttggcagtgagctgttttggcgtcgcagaaagaacttgttctattccttggaaggctttgccgtggaagagcgtcttgccatcatagaggtcatgttcggtgcaggctgggtcaggagtgagatcaaagtcacgggtgatgacactgggacgtggagcaggggaaagcacgacagtcgccttgtaagcagggactgacttgccattgacttgagatttgagaagcacttgaaccttgaccttgaccttgccagcatcctcttgttcctcctttctccttgacaactcaaccctaaccggaacatcagctccattgtcaatggctatgcctttgaaaagctgggcatcctcaactgcccaaagctgatgtccagcgtagatgctctgagcttggtgagccatgtagccgacagccagtgtcatcggcaaaacccttctcccttgaatgacatgtgaatccaagaaggggttgtcgctctgacgaagagtctgcaaaacagtgtgctcagtggcacttggaaccacaggtggcactccccagttcccaacaaggagctgaccagggctggagctgacaagcatgttcgcaactgtctgtgctccaccttgacgagggataatctgaatgcccattctgatgaagttggccttgagtgcaggcgtcaccatccctccatcccacggaccaaagcaaatggatctcgcacaaagttggggatgcacagcagacagatgtgcagccagcttgttgagagcctcattggccattgcatagtcactctgaccaacattgccgtggaacccagcaagggagctgaagagcaccaggtgcctaagctgtgcaagatccacacaggcaaggaggttgatgagtccaccaacctttgtgtcatacacagcactgaaatcagccagtgacttgttctcaaccaacttgtctctcaaaacaccacttgcatgaaacacaccgctgacccttctccctccttgctgttgaaccctctcaaccatttcacgaaccttggctgcagagctgacatcacaggactcatagacagctgtggcaccttgagcagttatctctgccaggctcgcacggacctctctagctcccacaacagctccaacaagtttcttgtggagcatcggtgtcggcttcgctccccttccagctgcaaactcagctttgaggaacgccagcgcagccttctcaagaggtttccctgactcaacaccaacagcccaggcaggttccgtggtgggcagctcacttctcccaatgaggacataggttccacctcccaccctctgtgccaattctctcacacaaagaggtgtgattccacgagcacctccagagaccaggaacaaatcactggaagagatcggttgatgtggttttcccgtggtgagagactttgtggttgtggtgcatctttgcccagatgcggagtaaccagactccctcactgccacatctgggtctgaaagctcacccaaaagacatctggcagcttgtgcagcatccaagtcagctgcaaggtcgattcctctgcagaaaacagcaggccattccaagtcaagggttttgcagagtccaaagactgagccttgctgcgctctggagagatcaacagtggcagtcgtggactttccagacaaccccaactgaccatccaacctcgcaacggcaacaaagaaggtcctcccaccttctatctgttctgacaaggacgttttgagatgtttggcagcaagcagtgcccaaccaagctgcgcttggacatcgtcatcaccaaactggaacacaaaacctcccacttttccaaactgtgcttcaactgatgtgagcgcagcttgcaatgcagcttcagaacggtctgcaacagtgaccaacttgtgcgtggtgcttctgggtgaacaggcagagctggactgaacttgcaagagcacagcacgatcaccaagtgaggacacaagagaactggtgagtgcagagccatcgtcaaccacaaccacaggacgtgctccaccttcagccagcacaagttcagcaggaagaggcagggttgtgatgactgggaaagtcaagctcaaatcttcacactcagaaccaaacaaagttggaaggagggcaggtgctgacggagctgcaggagctgaacctccagaggcagcaactatctcagccttcatggcatcgaccacttctccaaccgttctggtccttgacaacgcatcgacatctttggcctcaacacccagctgaccttgaacctcagaaaggatttccacacgcttgatgctatcaatcccaagctcggcttccaagtccatgtcagcctcaaccatgtcagcctcgtagccagtcttggcagccaaaacagccatgacaacagtttcagcttttgaaaggagggcttgcaaatcagcactaggagcggtggctggcgtgggagctgcagaggctgctggtgcggacggaacggcagctgcaggtgctgaccctcctgacgctgccactatctcagccttcatggcatcaaccacctctcccaccgtccttgttctggaaagagcatcaacatctttggcctccaccccaagctgaccttgaacctcagagaggatttcaacacgtttgatggagtcaattccaagttcagcttccagatccatgtccgcttccaccatgtctgcctcatagccagttttcgcagcaaggactgccatcacaactgtctcagccttgctcaggagagcttgaaggtccgcacttggtgcagtagaggcagctggtgtgggagcggcggaggcagctggtgcgcttgggacagcgggtgcgggagcagaaccagcactggcagcaacaatctctgccttcatcgcatcaacgacctcaccaactgttctggtccttgagagggcatccacatccttcgcctccactccgagctgtccttggacttcactgagaatctcaacacgcttgatgctgtcaatgcccaattcagcctcaaggtccatgtcggcttccaccatatcagcctcatagccagttttcgcagccaggacagccatgacaactgtttcagccttcgcaagcaatgcctgcagatccgcactcggtgctgtggcagctgcaggagtcggagctgcgctggctgctggagctgacgggaccgcaggtgcaggtgcagatccaccgctggcagcgacaatctcagccttcatcgcatcgacaacttccccaacagttctggtcctactgagggcatcaacgtctttcgcttcaactccgagctgaccttgcacctcagagagtatctccactcttttgatggaatctattccaagttcggcttccaaatccatgtcagcttcaaccatgtcggcttcgtaaccagtctttgcagcaaggacagccatcacaactgtttcggctttggacagcaaggcttggaggtctgcagaaggagccgtggatgcagctggagttggagccgctgacgctgcaggtgcagaaggaactgctggagcaggagcggagccagcagaggcagccacaatctcagccttcatggcgtccacgacctcaccgacggttctggttcttgaaagcgcatcgacatctttggcttccacacccaactgtccttggacctcagacaagatttcaacacgtttgatgctatctattcccaactccgcttcaaggtccatgtcagcttccaccatgtcagcctcgtaaccagttttcgctgcgagcacagccatcacaaccgtctcggctttagacaggagagcctgaagatcagcactcggagcggtactcgcagcaggtgtcggagccgctgatgcagctggtgcagaggggacagcaggtgctgacccaccagatgcagcaacaatctcagccttcatggcatccacaacctctccgacggtccttgtacgtgaaagggcatcaacatccttcgcttcaactccgagctgcccttggacttcactcaggatctccacccttttgatggaatcaatcccaagctcagcctccaaatccatatctgcttccaccatgtctgcctcgtagccagtctttgcagccaaaactgccatcacgaccgtctcagctttcgccaggagtgcttggaggtcggctgatcctctggtggacttgctgtttccgctaactggtgaggatgttggtgtaggggaagaagtgggtgttggaacgactgttgccacgggaactgcttgctcatcacaatcttggagcatcctctggagcagttccttgtgtctcctaagcacttccgcagctgcattggagtcagagttctcacctttctcttgctgttgctgttgaaccttcctctccaagtcttggattgtcctctccaattcagcgaccttggattgagctgcttgggctgcagtgcttgcttcagcaagctgacgctggaggtcttgtgcttgtctgacaagtctctcttcgtttgcagtgtccacttctttgacaaccgctgtggcaccactcacagtgtaaccatcattgagcacagcctccctctgcctcaaggtcttggcagagacataggtggcagcactcaacctcaaggttgttttctttttcttgacaggctcaagacgagtggcatcgggaagctgccatctgtcaaagtctttgagtggaacaccagccacagccaaggtgagagctgcttgtctcagctgggtgtctgaatccttggctgagtctgggttgacagccaccgtgaccacgtctccagcttccccaagggtctctttgaccaaacgagaaaggacttgcttgggaccgaactcaacaaacacccttgctccagctgcgtgcatggcacggacttgctgcacaaactgcacaggagaagtcatgtgtttcccaaggttcgttttgacatcagcaggagaggtgactgcagctccaccagtgacgttgctgtagaatctggcagctgcaggtgcggacactggagcttgagcaagcgcagacgcaaatgtctgctctgctccacgcatgtgtggtgaatggaaggcagcttcacaagcaagaggaaccactctgaagtttccactacaacgaagtttgtcagatgcagctgccactgcttcagcagttcccgtgatcaccgtctgtgatggactgttgctattggccagccaaacatcaggtgctccaccaaggctgagctgatcagccttggctcctatgaccgctgccatagcacctccactggagctggcttgagcagtgaaatcagacatggcctttgccctagcgcaaaccaagtcaaacacagcatcacgatccaatgaaccagctgcatagagagctgcaaactctcccagggaatgtccagctgcaaaagaaggagccaatccagctgctttgaagatgtcaaaggcaccgacagagcaagcgagggttgctggctgagagtaacgcgtctgagaaatctctttgtgatcttgccttggctcatctccataaggttttctcggatagagaacactggagactcttttggctggcctcccaaaacgttctctctgcgctctgtccatcgcagcaacactctctctgaacggaggccagttcatggcaacatctgagaacatgtgagtgtactgcgctccttggccagagaaaagtgcagcaacattggcctctgtggcaacacccctaactctgaatgcagcctcaccagtggcaactgagaccgtccattccgttgctgactcttctccagcaagtttggctgcagctgcttccaaaaccgcaatgagagaggacaggtccctcaccagaagtccaacccttgcgtgggcttggggaacagctcctctcaacttacattcatcaaggaacctatggtatgcaatgtaatcagcgttcttcacaactctagcctcttcttgctcagcagtggccaatgccagttttgccctaactgtggcagcaagagttgcaacatccccagcatgaaggagagcaacttggggaagattgttgtaacggtaagcactctcatgttcaggttcaaactcttcaagcacagcatggtagttcgcacctccaaaaccaaatgaggaaacgccagctctcctcggaaccccaaccggagtgaaccagggacggttcatggtgttgacgtacaaaggggactgttgaatcggtgtcccatccaccagtgaaggtggcttgtccacattgatcgtctgaggcaatgtcttgtgcttgagagcaaggaccactttgaccaatccagccaatccagcaaccgctttgaggtgccctatctggctcttgatgctgccaacagcaacttgctcagcttcctcagctccacctccattcgcagaaaacgctttggagaagagattgctcagagctgtgagttcaatcttgtccccaaccggagtgccagttccatgtccttcaacaagagtgacagtggctgggtccacattggcacgtgcataggctctacggagagcctcttcttgtccgctgattgtcggtgtgtagattccagctgcttttccatcacttgaggaagcacagcccttgatgacagcatgaacagtgtcaccatctctgacagcatccgcatatctcttcagaacaagcatcgcagatccttcaccaatcaacatgcctttggtggcagcatcatacgctttgacactcgggtccgtagagaaaacaggcgtcttggagaaggccatgtacatccctattgaattgtctgtgcaggtggcaccagcaatcatggcatcacagtcaccatagagaagctcttctattgccaccttgaccgcaatcaggcttgaagcacaggcagcgtcaacgacacagttcatgccctccatgttgaaggtgttgcaacatctgccagcggtaacattgcccaagaaaccaggaaaagaatcaagcctccactctgggaagctcgccttgtacttgtccaccgcagctgccacatcttcctctggcaaacccatctttctgagcactttgtcaaccacaacatagttgagtctggagtagaactcatgtgacgccttctgacctccacctatgccaagaacacaaccaatgttctttttgccacttgagaaagcaggtatgttggcatcggtgagagcttccttcaccttgagcaatgagatggtctggttcgcatcagaatcttccatctggaacatgttgaggccaaactcacgagcatcaaagtcatactcagggatgaacccacctcttttgcagtagattttgtccttggtcgttttctctggattgtaataggcagtcacatccacacgatccgcaggcagatcagacagacaatccaagccatctctgatggcctcccagctctctctaacattctcaccactcggaaggatcgcactcattcccacaatggcaattctggtatccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaagatgagtgatactcaggactcaggactcactctgctgatcactagtgctagcctcgaggtcgacacaactttgtatacaaaagttgtctagacctagggcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccttttagtattaagagaagaaccaaaggctttgttgttttcataatctttctgtcattttcttttattatgatgtcaagtcaagcgactctttggtagtaatctgtatgccatggatctctctctctatttgtcgactgaaaacttttgggttacacatgaaagctttttctttttctaaaatccaaaatgaaagagttgtattaacagatacataagtgaaagagtagtccctaagatgacactagcttcatttataaacaatcctatcacattgtatatacaggttatgatttattcccaatcagcgtcaaagaatccagcatctttcatctctgaatagtagacattctccaagtttagatcttcctcctcgatcaaagcggccgcttaattaaactagaaccggtgactactctacagccttggattaggcacggcatcgcgatctcttgggccgttgacttttaacttgcgatgacttttctaatttacgagtcaataaccattctccctcagatattgacttgttcgtagataagtgtcactttggaagctagcattacgagtacacgggtcggcaacttgcaaatcgtcgaaaattgctatgcaagttgatctctgatttggtagtacactcagctttgtgatcagccaatactcattacgtggtttattagcaaaatgaatcgacatgagccacagcgagtgacaccagttacgattccctcacaacctccgtctcgtgaaacgtaatagatcagcgttgtatgatgtaagatattgtagttttggatgtcaacgtagggtcgtgaagaggtttattaactcacatgttggaacccttagtgagttttcactttacaaatcacgcgtgccactacgtattacttcatcgtagatagggacaacacagaaacgaaagtgcgaaacctttacatcaccaggtcccaggcgagattcccaggggtgactaaaagtacgcatttgaaaactatgggggctattgaatctaaacatcagatagtcaccatgatcaatatccccgttacgcttgcttcgtaatctgggggagtagccgcttcccgcgcttacgagcgtgctcaagggccatacaaactgaccccagtgagccgttcagagtgcgtgccattgagaattggcgtacttctgttgaaaaaagtgcgataacgctcttcagggtggtcgataacccaagcgtagaatcacactttgcagaggatatgaggttcttaactaggatacttggggcgatcatcaagtaaggatgaagtcgcgtacgtactttctacatgctcagctaaagtgcaagcgggggacatgacgagatgattccaggaatcggggacattggcttagggcttatagatgtcttgttcgataacaccggtggatccccgggtaccgagctcgaattcctcgaggtcgaccaacttttctatacaaagttgtctaggtcgacctcgaggctagcactagtttaattaagcggccgcgtcgacggatccgtacggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgagctcggtgacctaagtgattaagctaactactcagagtgcatgatctggtctgtaggtgaagaggtcatcttcagtgtccacatctatccttggtgcaagtttgacactgagcaatctctggagatacgcagcaccagacaggatttgaaggttgatctgcacaacatcagggaactcaccagagactgcaacatcaagatagctgtctgcaatgaaatcgttgaaggctcctatggcaggtccacaccaaatctggtaatccatcgtacggtcagctatgccattgtttgcccagaatgagctgagacccaagtaccaacggaagcagagggacatcttgagcttggggtcctcattctcagcctttctgatcttttcaggattgttgagacgagtgatgtagaaatctttggtctctgcccaaacttctgcaagggacttggagaagatcctcttctcaacacgagccaattcatccgcaggcattgcttcaaaggaatcatacttgtggaacagttcaaagagtttcttggcacgagatgggaacatcgttcctttcttgagaacttgcagttcaactccttgttcaaacatgtctgcagctggtgccatcgtgatgtcagagtaagtggcacgagagagctgacgcctcacgttgtcacatgttccagcttgacgggacagctggttgacagtgccagtcacaacaaacgcagctcccatgtggaaggctccaagtgcagcttgaggacaacctatgcctccaccagcaccaaccctaacacggtgtctggcagggtacttgagttccctctggagcctattcctcagactgaggatcaacggcagaatgacatgaatgggacggttgtcagtgtgccctccactgtcagcctcaactgcaatgtcatcagccattggaacttcaagagccaacgcagcttgctcaggggtgatttcaccagacgcaacaagtttgtccagaattgcttgaggtgcaggtctgatgaacatctccgcaagctctgttctggaaacctttcctatgatcttgtgtgctgtcctcactgagccacctctcgcatctctggagagtcccgtggctctgtaacggaccacttgtggtgtgagttccatgaaggcagacgcctcaaccacacgaactcccttttccaggaaaagatcaacattgcccttttccaggttggcatcgaacggtgagtggatgaggttgacagcatacggaccagcgggaagtgcagcttggatcttttcaatcccagcacggacaacgtgcattggcaacccaccagctccaaagctccccaacatcttcctctgacccattgctatgaccagatccgcagaggctattcccttggccatcgcaccactgtacaacggagcaaccaccccataagtctccatgaatccacggtctcccaaatcgctgacagcacaggctggcacctcacttccagcatccaactgcaatggtctctccagtgtcagcaacgcttgtttgagagcttgaagatcagccacatccacatcagcaatgctggagttctttgtggtggctttggcagcaacttcttgctcttcaacatggccagctccagtctggattctgaccctcaggttgtctgctgaatagactctgaggccatcaacgaagaggaacccatcagcaaccacatcaacccatgaggagaaggcagcaacactcttgatgtgaacttcactgtccattctgtcattctttggggtcaactgacctctgtacttccagctggtggcaccaggtgcatgtgcaaagactggatgagcaattccatgccttgcagccaagccttgtttgacacaccacgcttccacaagctggaacatggactcaattcccaaagacccaggcatcactgggtcaaaccagaaatggcaagaaaagaaccaatcttgcttgttcacagctttctccccatgagcataaccttggccatgcactccagctccactcccagcaagatgaattgtgtccaggaactgcgcttgtgaccctctcctctgaagctgaagctgaccttgggcactagaagctgacgcaggtgctgagagtgtgtccactgccacattgttttccctataccaaggcaacctcggcttgccattgtccaatccagtctggctctcaaagacctcaggaacaaaccaaccaaaagaggtgctccctttgtagaaaactgctccgtcaacagagagttcgaaggtgaaacgatggattcccatcttgccaagcatggagtatcccgtgcatttggtgaagttccttatggttttccctctgacatcaggcatggcatcacccacaagttctgcatctgcatcaaggtttctgaaaaggatgtcatctttgtccattgtgagcggagctttgagcacagatgtgaggactccagaagtctgaagagcaatctccatcaagatgctgtacggcatgtgatcgtctctgcttgaggctccaaagaaccaagcatctgcaggacaatcaaactcacccaccatcgtgccttggccagggttgacatccacattgtagaaaggaccatgttccatgtcagccacactcgtcacccttgtcacaagagccaggtcaaaagctggtgatctggatgtcttggaagcatcaaatctggcaaactcaggacccaagcagttgctcacttttccacacatgaactcagacatgttgaaccaggtcaacggcatttggccaggtgtatgatcattgtcaagcggattgttggggaaaggagagaagcaaacagctctgggaggatacgctgaaggagagaaggacggagtgggtccaggacctccatttccctcagccattggatgccacgtgacagaggtgggagcagtgggatcacctttgaggcatccacttggaggagcaatcactctgctggttgtcgtggtcgtagtggtgacagtcatgctctctttctgttgctccttccttttctgcagtgacaacgcaattcccttgaaatccacaactatctttttcctcaaatctccttggccatagctgtgaagatcctcaactccagcaaacgcttgtccctcttcaaagttgacatcaatgatgtcaacatcagctatggcaaatggatctccagttttggcatcaaagcccatttctttgatctccatgacataaacaagtttccccttgtgcggtgaaatctgtccacgacacctcactttgttggcatgaccactgactggacgaaagtcgaacgcaccaacagtggtgtgaaggccaagccacaacatgtaaaccttgagaagctgagagcatccatctgagacaagagaaccagccatgacctcatccctcacaaagtggcaggggaagtaccagtggtccctctcaagcactttctccccaatgagaagcccaagaccgtgagcacctccacgcggatcaaggtgtgtgactctgtcaatcatcagcatctttctcgcacacaacttgtagtctatgccagccattccagaaccaaagacccttgcccattgcctatcaacaagcagtctcatttctctggcatccaagctggttttgtgactgcacggtgcaggtgcaaagggtgcaatgtcttgtttctggatctgagcacgtgcagcaagctcagccttcgttttgagcacaccttttccagcggcaagttcggcatcagtaaagaagccagcacaaccatctctcatctctatgagcaatctgccatcaacaaagcagtcatactcgaaaaagaacattgagatttccccaccagcacccttggcgaaaccagtgactctgatgtcatacacaagggtttctccttcatgggcaaccccaaagaaggtgagagatgtgttgagcaatctgtaaacacggtcccctttgcactggaagtcaatccccatgtaggagatgagcatcaagtcacactgcccactttcaacaagaactgcccagggaacatcacctccctctgacaactcaccattgactggaacatcatactcagtgaccattctggagccaactctgaagttattcacctcggcatccatgagagtcactcttgaaacaagcaagtattctctggctggaagcctcacacgccttctgtacttgtcaatgatgtcaaactctggtccaaacacttgaccaacatcaccctccgcaaactccaacagctcgttgtagtcaaagacaaccgtcttgccatccaacagctcttccttgctcatttcccaaacaggagttttctttgaagatgtcatttttggttgtggatccctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctactaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggagcggccgccctaggtctagatcgacacaactttgtataataaagttgtctagacctagggcggccgcagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcaccgagctcagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaaactagtgctagcctcgaggtcgacacccagcttt

SEQ ID NO: 37 - DNA, 38299 bp, Artificial Sequence
  Plasmid pDAB112208
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctaggtcgacctcgaggctagcactagtttaattaagcggccgcgtcgacggatccgtacggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgagctcggtgacctaagtgattaagctaactactcatcagtatgtgagtgtcttgttgaggacaacactggctctcgcagagaagtacacttcaccttgctcatcgtgcatggcaacagtgcatttgcacacagaatccaccaatggtgaagctgaagccagtttgacactggtatagtaagttgctccaggagccatcggtttgtagaaatcaaacctttcacagttattgggcagcgcagcagactgtctcaacatcctagcccaaacaagcatggcttggaaagcaatgtcagcttggaatgggtcttgctggctgagattgaccacaaactggccacgctgctccggtgtgagtggaaggtttctgcatttggcagtgagctgttttggcgtcgcagaaagaacttgttctattccttggaaggctttgccgtggaagagcgtcttgccatcatagaggtcatgttcggtgcaggctgggtcaggagtgagatcaaagtcacgggtgatgacactgggacgtggagcaggggaaagcacgacagtcgccttgtaagcagggactgacttgccattgacttgagatttgagaagcacttgaaccttgaccttgaccttgccagcatcctcttgttcctcctttctccttgacaactcaaccctaaccggaacatcagctccattgtcaatggctatgcctttgaaaagctgggcatcctcaactgcccaaagctgatgtccagcgtagatgctctgagcttggtgagccatgtagccgacagccagtgtcatcggcaaaacccttctcccttgaatgacatgtgaatccaagaaggggttgtcgctctgacgaagagtctgcaaaacagtgtgctcagtggcacttggaaccacaggtggcactccccagttcccaacaaggagctgaccagggctggagctgacaagcatgttcgcaactgtctgtgctccaccttgacgagggataatctgaatgcccattctgatgaagttggccttgagtgcaggcgtcaccatccctccatcccacggaccaaagcaaatggatctcgcacaaagttggggatgcacagcagacagatgtgcagccagcttgttgagagcctcattggccattgcatagtcactctgaccaacattgccgtggaacccagcaagggagctgaagagcaccaggtgcctaagctgtgcaagatccacacaggcaaggaggttgatgagtccaccaacctttgtgtcatacacagcactgaaatcagccagtgacttgttctcaaccaacttgtctctcaaaacaccacttgcatgaaacacaccgctgacccttctccctccttgctgttgaaccctctcaaccatttcacgaaccttggctgcagagctgacatcacaggactcatagacagctgtggcaccttgagcagttatctctgccaggctcgcacggacctctctagctcccacaacagctccaacaagtttcttgtggagcatcggtgtcggcttcgctccccttccagctgcaaactcagctttgaggaacgccagcgcagccttctcaagaggtttccctgactcaacaccaacagcccaggcaggttccgtggtgggcagctcacttctcccaatgaggacataggttccacctcccaccctctgtgccaattctctcacacaaagaggtgtgattccacgagcacctccagagaccaggaacaaatcactggaagagatcggttgatgtggttttcccgtggtgagagactttgtggttgtggtgcatctttgcccagatgcggagtaaccagactccctcactgccacatctgggtctgaaagctcacccaaaagacatctggcagcttgtgcagcatccaagtcagctgcaaggtcgattcctctgcagaaaacagcaggccattccaagtcaagggttttgcagagtccaaagactgagccttgctgcgctctggagagatcaacagtggcagtcgtggactttccagacaaccccaactgaccatccaacctcgcaacggcaacaaagaaggtcctcccaccttctatctgttctgacaaggacgttttgagatgtttggcagcaagcagtgcccaaccaagctgcgcttggacatcgtcatcaccaaactggaacacaaaacctcccacttttccaaactgtgcttcaactgatgtgagcgcagcttgcaatgcagcttcagaacggtctgcaacagtgaccaacttgtgcgtggtgcttctgggtgaacaggcagagctggactgaacttgcaagagcacagcacgatcaccaagtgaggacacaagagaactggtgagtgcagagccatcgtcaaccacaaccacaggacgtgctccaccttcagccagcacaagttcagcaggaagaggcagggttgtgatgactgggaaagtcaagctcaaatcttcacactcagaaccaaacaaagttggaaggagggcaggtgctgacggagctgcaggagctgaacctccagaggcagcaactatctcagccttcatggcatcgaccacttctccaaccgttctggtccttgacaacgcatcgacatctttggcctcaacacccagctgaccttgaacctcagaaaggatttccacacgcttgatgctatcaatcccaagctcggcttccaagtccatgtcagcctcaaccatgtcagcctcgtagccagtcttggcagccaaaacagccatgacaacagtttcagcttttgaaaggagggcttgcaaatcagcactaggagcggtggctggcgtgggagctgcagaggctgctggtgcggacggaacggcagctgcaggtgctgaccctcctgacgctgccactatctcagccttcatggcatcaaccacctctcccaccgtccttgttctggaaagagcatcaacatctttggcctccaccccaagctgaccttgaacctcagagaggatttcaacacgtttgatggagtcaattccaagttcagcttccagatccatgtccgcttccaccatgtctgcctcatagccagttttcgcagcaaggactgccatcacaactgtctcagccttgctcaggagagcttgaaggtccgcacttggtgcagtagaggcagctggtgtgggagcggcggaggcagctggtgcgcttgggacagcgggtgcgggagcagaaccagcactggcagcaacaatctctgccttcatcgcatcaacgacctcaccaactgttctggtccttgagagggcatccacatccttcgcctccactccgagctgtccttggacttcactgagaatctcaacacgcttgatgctgtcaatgcccaattcagcctcaaggtccatgtcggcttccaccatatcagcctcatagccagttttcgcagccaggacagccatgacaactgtttcagccttcgcaagcaatgcctgcagatccgcactcggtgctgtggcagctgcaggagtcggagctgcgctggctgctggagctgacgggaccgcaggtgcaggtgcagatccaccgctggcagcgacaatctcagccttcatcgcatcgacaacttccccaacagttctggtcctactgagggcatcaacgtctttcgcttcaactccgagctgaccttgcacctcagagagtatctccactcttttgatggaatctattccaagttcggcttccaaatccatgtcagcttcaaccatgtcggcttcgtaaccagtctttgcagcaaggacagccatcacaactgtttcggctttggacagcaaggcttggaggtctgcagaaggagccgtggatgcagctggagttggagccgctgacgctgcaggtgcagaaggaactgctggagcaggagcggagccagcagaggcagccacaatctcagccttcatggcgtccacgacctcaccgacggttctggttcttgaaagcgcatcgacatctttggcttccacacccaactgtccttggacctcagacaagatttcaacacgtttgatgctatctattcccaactccgcttcaaggtccatgtcagcttccaccatgtcagcctcgtaaccagttttcgctgcgagcacagccatcacaaccgtctcggctttagacaggagagcctgaagatcagcactcggagcggtactcgcagcaggtgtcggagccgctgatgcagctggtgcagaggggacagcaggtgctgacccaccagatgcagcaacaatctcagccttcatggcatccacaacctctccgacggtccttgtacgtgaaagggcatcaacatccttcgcttcaactccgagctgcccttggacttcactcaggatctccacccttttgatggaatcaatcccaagctcagcctccaaatccatatctgcttccaccatgtctgcctcgtagccagtctttgcagccaaaactgccatcacgaccgtctcagctttcgccaggagtgcttggaggtcggctgatcctctggtggacttgctgtttccgctaactggtgaggatgttggtgtaggggaagaagtgggtgttggaacgactgttgccacgggaactgcttgctcatcacaatcttggagcatcctctggagcagttccttgtgtctcctaagcacttccgcagctgcattggagtcagagttctcacctttctcttgctgttgctgttgaaccttcctctccaagtcttggattgtcctctccaattcagcgaccttggattgagctgcttgggctgcagtgcttgcttcagcaagctgacgctggaggtcttgtgcttgtctgacaagtctctcttcgtttgcagtgtccacttctttgacaaccgctgtggcaccactcacagtgtaaccatcattgagcacagcctccctctgcctcaaggtcttggcagagacataggtggcagcactcaacctcaaggttgttttctttttcttgacaggctcaagacgagtggcatcgggaagctgccatctgtcaaagtctttgagtggaacaccagccacagccaaggtgagagctgcttgtctcagctgggtgtctgaatccttggctgagtctgggttgacagccaccgtgaccacgtctccagcttccccaagggtctctttgaccaaacgagaaaggacttgcttgggaccgaactcaacaaacacccttgctccagctgcgtgcatggcacggacttgctgcacaaactgcacaggagaagtcatgtgtttcccaaggttcgttttgacatcagcaggagaggtgactgcagctccaccagtgacgttgctgtagaatctggcagctgcaggtgcggacactggagcttgagcaagcgcagacgcaaatgtctgctctgctccacgcatgtgtggtgaatggaaggcagcttcacaagcaagaggaaccactctgaagtttccactacaacgaagtttgtcagatgcagctgccactgcttcagcagttcccgtgatcaccgtctgtgatggactgttgctattggccagccaaacatcaggtgctccaccaaggctgagctgatcagccttggctcctatgaccgctgccatagcacctccactggagctggcttgagcagtgaaatcagacatggcctttgccctagcgcaaaccaagtcaaacacagcatcacgatccaatgaaccagctgcatagagagctgcaaactctcccagggaatgtccagctgcaaaagaaggagccaatccagctgctttgaagatgtcaaaggcaccgacagagcaagcgagggttgctggctgagagtaacgcgtctgagaaatctctttgtgatcttgccttggctcatctccataaggttttctcggatagagaacactggagactcttttggctggcctcccaaaacgttctctctgcgctctgtccatcgcagcaacactctctctgaacggaggccagttcatggcaacatctgagaacatgtgagtgtactgcgctccttggccagagaaaagtgcagcaacattggcctctgtggcaacacccctaactctgaatgcagcctcaccagtggcaactgagaccgtccattccgttgctgactcttctccagcaagtttggctgcagctgcttccaaaaccgcaatgagagaggacaggtccctcaccagaagtccaacccttgcgtgggcttggggaacagctcctctcaacttacattcatcaaggaacctatggtatgcaatgtaatcagcgttcttcacaactctagcctcttcttgctcagcagtggccaatgccagttttgccctaactgtggcagcaagagttgcaacatccccagcatgaaggagagcaacttggggaagattgttgtaacggtaagcactctcatgttcaggttcaaactcttcaagcacagcatggtagttcgcacctccaaaaccaaatgaggaaacgccagctctcctcggaaccccaaccggagtgaaccagggacggttcatggtgttgacgtacaaaggggactgttgaatcggtgtcccatccaccagtgaaggtggcttgtccacattgatcgtctgaggcaatgtcttgtgcttgagagcaaggaccactttgaccaatccagccaatccagcaaccgctttgaggtgccctatctggctcttgatgctgccaacagcaacttgctcagcttcctcagctccacctccattcgcagaaaacgctttggagaagagattgctcagagctgtgagttcaatcttgtccccaaccggagtgccagttccatgtccttcaacaagagtgacagtggctgggtccacattggcacgtgcataggctctacggagagcctcttcttgtccgctgattgtcggtgtgtagattccagctgcttttccatcacttgaggaagcacagcccttgatgacagcatgaacagtgtcaccatctctgacagcatccgcatatctcttcagaacaagcatcgcagatccttcaccaatcaacatgcctttggtggcagcatcatacgctttgacactcgggtccgtagagaaaacaggcgtcttggagaaggccatgtacatccctattgaattgtctgtgcaggtggcaccagcaatcatggcatcacagtcaccatagagaagctcttctattgccaccttgaccgcaatcaggcttgaagcacaggcagcgtcaacgacacagttcatgccctccatgttgaaggtgttgcaacatctgccagcggtaacattgcccaagaaaccaggaaaagaatcaagcctccactctgggaagctcgccttgtacttgtccaccgcagctgccacatcttcctctggcaaacccatctttctgagcactttgtcaaccacaacatagttgagtctggagtagaactcatgtgacgccttctgacctccacctatgccaagaacacaaccaatgttctttttgccacttgagaaagcaggtatgttggcatcggtgagagcttccttcaccttgagcaatgagatggtctggttcgcatcagaatcttccatctggaacatgttgaggccaaactcacgagcatcaaagtcatactcagggatgaacccacctcttttgcagtagattttgtccttggtcgttttctctggattgtaataggcagtcacatccacacgatccgcaggcagatcagacagacaatccaagccatctctgatggcctcccagctctctctaacattctcaccactcggaaggatcgcactcattcccacaatggcaattctggtatccatttttggttgtggatccctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctactaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggagcggccgccctaggtctagatcgacacaactttgtatacaaaagttgtctagacctagggcggccgcagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccgagctcagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaactactgtcactgaggccgtagacgagtacggactgatctaactagaaccggtgactactctacagccttggattaggcacggcatcgcgatctcttgggccgttgacttttaacttgcgatgacttttctaatttacgagtcaataaccattctccctcagatattgacttgttcgtagataagtgtcactttggaagctagcattacgagtacacgggtcggcaacttgcaaatcgtcgaaaattgctatgcaagttgatctctgatttggtagtacactcagctttgtgatcagccaatactcattacgtggtttattagcaaaatgaatcgacatgagccacagcgagtgacaccagttacgattccctcacaacctccgtctcgtgaaacgtaatagatcagcgttgtatgatgtaagatattgtagttttggatgtcaacgtagggtcgtgaagaggtttattaactcacatgttggaacccttagtgagttttcactttacaaatcacgcgtgccactacgtattacttcatcgtagatagggacaacacagaaacgaaagtgcgaaacctttacatcaccaggtcccaggcgagattcccaggggtgactaaaagtacgcatttgaaaactatgggggctattgaatctaaacatcagatagtcaccatgatcaatatccccgttacgcttgcttcgtaatctgggggagtagccgcttcccgcgcttacgagcgtgctcaagggccatacaaactgaccccagtgagccgttcagagtgcgtgccattgagaattggcgtacttctgttgaaaaaagtgcgataacgctcttcagggtggtcgataacccaagcgtagaatcacactttgcagaggatatgaggttcttaactaggatacttggggcgatcatcaagtaaggatgaagtcgcgtacgtactttctacatgctcagctaaagtgcaagcgggggacatgacgagatgattccaggaatcggggacattggcttagggcttatagatgtcttgttcgataacaccggtggatccccgggtaccgagctcgaattcgcggccgcttaattaaactagtgctagcctcgaggtcgaccaacttttctatacaaagttgtctaggtcgacctcgaggctagcactagtttaattaagcggccgcgtcgacggatccgtacggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgagctcggtgacctaagtgattaagctaactactcagagtgcatgatctggtctgtaggtgaagaggtcatcttcagtgtccacatctatccttggtgcaagtttgacactgagcaatctctggagatacgcagcaccagacaggatttgaaggttgatctgcacaacatcagggaactcaccagagactgcaacatcaagatagctgtctgcaatgaaatcgttgaaggctcctatggcaggtccacaccaaatctggtaatccatcgtacggtcagctatgccattgtttgcccagaatgagctgagacccaagtaccaacggaagcagagggacatcttgagcttggggtcctcattctcagcctttctgatcttttcaggattgttgagacgagtgatgtagaaatctttggtctctgcccaaacttctgcaagggacttggagaagatcctcttctcaacacgagccaattcatccgcaggcattgcttcaaaggaatcatacttgtggaacagttcaaagagtttcttggcacgagatgggaacatcgttcctttcttgagaacttgcagttcaactccttgttcaaacatgtctgcagctggtgccatcgtgatgtcagagtaagtggcacgagagagctgacgcctcacgttgtcacatgttccagcttgacgggacagctggttgacagtgccagtcacaacaaacgcagctcccatgtggaaggctccaagtgcagcttgaggacaacctatgcctccaccagcaccaaccctaacacggtgtctggcagggtacttgagttccctctggagcctattcctcagactgaggatcaacggcagaatgacatgaatgggacggttgtcagtgtgccctccactgtcagcctcaactgcaatgtcatcagccattggaacttcaagagccaacgcagcttgctcaggggtgatttcaccagacgcaacaagtttgtccagaattgcttgaggtgcaggtctgatgaacatctccgcaagctctgttctggaaacctttcctatgatcttgtgtgctgtcctcactgagccacctctcgcatctctggagagtcccgtggctctgtaacggaccacttgtggtgtgagttccatgaaggcagacgcctcaaccacacgaactcccttttccaggaaaagatcaacattgcccttttccaggttggcatcgaacggtgagtggatgaggttgacagcatacggaccagcgggaagtgcagcttggatcttttcaatcccagcacggacaacgtgcattggcaacccaccagctccaaagctccccaacatcttcctctgacccattgctatgaccagatccgcagaggctattcccttggccatcgcaccactgtacaacggagcaaccaccccataagtctccatgaatccacggtctcccaaatcgctgacagcacaggctggcacctcacttccagcatccaactgcaatggtctctccagtgtcagcaacgcttgtttgagagcttgaagatcagccacatccacatcagcaatgctggagttctttgtggtggctttggcagcaacttcttgctcttcaacatggccagctccagtctggattctgaccctcaggttgtctgctgaatagactctgaggccatcaacgaagaggaacccatcagcaaccacatcaacccatgaggagaaggcagcaacactcttgatgtgaacttcactgtccattctgtcattctttggggtcaactgacctctgtacttccagctggtggcaccaggtgcatgtgcaaagactggatgagcaattccatgccttgcagccaagccttgtttgacacaccacgcttccacaagctggaacatggactcaattcccaaagacccaggcatcactgggtcaaaccagaaatggcaagaaaagaaccaatcttgcttgttcacagctttctccccatgagcataaccttggccatgcactccagctccactcccagcaagatgaattgtgtccaggaactgcgcttgtgaccctctcctctgaagctgaagctgaccttgggcactagaagctgacgcaggtgctgagagtgtgtccactgccacattgttttccctataccaaggcaacctcggcttgccattgtccaatccagtctggctctcaaagacctcaggaacaaaccaaccaaaagaggtgctccctttgtagaaaactgctccgtcaacagagagttcgaaggtgaaacgatggattcccatcttgccaagcatggagtatcccgtgcatttggtgaagttccttatggttttccctctgacatcaggcatggcatcacccacaagttctgcatctgcatcaaggtttctgaaaaggatgtcatctttgtccattgtgagcggagctttgagcacagatgtgaggactccagaagtctgaagagcaatctccatcaagatgctgtacggcatgtgatcgtctctgcttgaggctccaaagaaccaagcatctgcaggacaatcaaactcacccaccatcgtgccttggccagggttgacatccacattgtagaaaggaccatgttccatgtcagccacactcgtcacccttgtcacaagagccaggtcaaaagctggtgatctggatgtcttggaagcatcaaatctggcaaactcaggacccaagcagttgctcacttttccacacatgaactcagacatgttgaaccaggtcaacggcatttggccaggtgtatgatcattgtcaagcggattgttggggaaaggagagaagcaaacagctctgggaggatacgctgaaggagagaaggacggagtgggtccaggacctccatttccctcagccattggatgccacgtgacagaggtgggagcagtgggatcacctttgaggcatccacttggaggagcaatcactctgctggttgtcgtggtcgtagtggtgacagtcatgctctctttctgttgctccttccttttctgcagtgacaacgcaattcccttgaaatccacaactatctttttcctcaaatctccttggccatagctgtgaagatcctcaactccagcaaacgcttgtccctcttcaaagttgacatcaatgatgtcaacatcagctatggcaaatggatctccagttttggcatcaaagcccatttctttgatctccatgacataaacaagtttccccttgtgcggtgaaatctgtccacgacacctcactttgttggcatgaccactgactggacgaaagtcgaacgcaccaacagtggtgtgaaggccaagccacaacatgtaaaccttgagaagctgagagcatccatctgagacaagagaaccagccatgacctcatccctcacaaagtggcaggggaagtaccagtggtccctctcaagcactttctccccaatgagaagcccaagaccgtgagcacctccacgcggatcaaggtgtgtgactctgtcaatcatcagcatctttctcgcacacaacttgtagtctatgccagccattccagaaccaaagacccttgcccattgcctatcaacaagcagtctcatttctctggcatccaagctggttttgtgactgcacggtgcaggtgcaaagggtgcaatgtcttgtttctggatctgagcacgtgcagcaagctcagccttcgttttgagcacaccttttccagcggcaagttcggcatcagtaaagaagccagcacaaccatctctcatctctatgagcaatctgccatcaacaaagcagtcatactcgaaaaagaacattgagatttccccaccagcacccttggcgaaaccagtgactctgatgtcatacacaagggtttctccttcatgggcaaccccaaagaaggtgagagatgtgttgagcaatctgtaaacacggtcccctttgcactggaagtcaatccccatgtaggagatgagcatcaagtcacactgcccactttcaacaagaactgcccagggaacatcacctccctctgacaactcaccattgactggaacatcatactcagtgaccattctggagccaactctgaagttattcacctcggcatccatgagagtcactcttgaaacaagcaagtattctctggctggaagcctcacacgccttctgtacttgtcaatgatgtcaaactctggtccaaacacttgaccaacatcaccctccgcaaactccaacagctcgttgtagtcaaagacaaccgtcttgccatccaacagctcttccttgctcatttcccaaacaggagttttctttgaagatgtcatttttggttgtggatccctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctactaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggagcggccgccctaggtctagatcgacacaactttgtataataaagttgtctagacctagggcggccgcagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcaccgagctcagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaaactagtgctagcctcgaggtcgacacccagcttt

SEQ ID NO: 38 - DNA, 36021 bp, Artificial Sequence
  Plasmid pDAB112209
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctaggtcgacctcgaggctagcactagtttaattaagcggccgcgtcgacggatccgtacggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgagctcggtgacctaagtgattaagctaactactcatcagtatgtgagtgtcttgttgaggacaacactggctctcgcagagaagtacacttcaccttgctcatcgtgcatggcaacagtgcatttgcacacagaatccaccaatggtgaagctgaagccagtttgacactggtatagtaagttgctccaggagccatcggtttgtagaaatcaaacctttcacagttattgggcagcgcagcagactgtctcaacatcctagcccaaacaagcatggcttggaaagcaatgtcagcttggaatgggtcttgctggctgagattgaccacaaactggccacgctgctccggtgtgagtggaaggtttctgcatttggcagtgagctgttttggcgtcgcagaaagaacttgttctattccttggaaggctttgccgtggaagagcgtcttgccatcatagaggtcatgttcggtgcaggctgggtcaggagtgagatcaaagtcacgggtgatgacactgggacgtggagcaggggaaagcacgacagtcgccttgtaagcagggactgacttgccattgacttgagatttgagaagcacttgaaccttgaccttgaccttgccagcatcctcttgttcctcctttctccttgacaactcaaccctaaccggaacatcagctccattgtcaatggctatgcctttgaaaagctgggcatcctcaactgcccaaagctgatgtccagcgtagatgctctgagcttggtgagccatgtagccgacagccagtgtcatcggcaaaacccttctcccttgaatgacatgtgaatccaagaaggggttgtcgctctgacgaagagtctgcaaaacagtgtgctcagtggcacttggaaccacaggtggcactccccagttcccaacaaggagctgaccagggctggagctgacaagcatgttcgcaactgtctgtgctccaccttgacgagggataatctgaatgcccattctgatgaagttggccttgagtgcaggcgtcaccatccctccatcccacggaccaaagcaaatggatctcgcacaaagttggggatgcacagcagacagatgtgcagccagcttgttgagagcctcattggccattgcatagtcactctgaccaacattgccgtggaacccagcaagggagctgaagagcaccaggtgcctaagctgtgcaagatccacacaggcaaggaggttgatgagtccaccaacctttgtgtcatacacagcactgaaatcagccagtgacttgttctcaaccaacttgtctctcaaaacaccacttgcatgaaacacaccgctgacccttctccctccttgctgttgaaccctctcaaccatttcacgaaccttggctgcagagctgacatcacaggactcatagacagctgtggcaccttgagcagttatctctgccaggctcgcacggacctctctagctcccacaacagctccaacaagtttcttgtggagcatcggtgtcggcttcgctccccttccagctgcaaactcagctttgaggaacgccagcgcagccttctcaagaggtttccctgactcaacaccaacagcccaggcaggttccgtggtgggcagctcacttctcccaatgaggacataggttccacctcccaccctctgtgccaattctctcacacaaagaggtgtgattccacgagcacctccagagaccaggaacaaatcactggaagagatcggttgatgtggttttcccgtggtgagagactttgtggttgtggtgcatctttgcccagatgcggagtaaccagactccctcactgccacatctgggtctgaaagctcacccaaaagacatctggcagcttgtgcagcatccaagtcagctgcaaggtcgattcctctgcagaaaacagcaggccattccaagtcaagggttttgcagagtccaaagactgagccttgctgcgctctggagagatcaacagtggcagtcgtggactttccagacaaccccaactgaccatccaacctcgcaacggcaacaaagaaggtcctcccaccttctatctgttctgacaaggacgttttgagatgtttggcagcaagcagtgcccaaccaagctgcgcttggacatcgtcatcaccaaactggaacacaaaacctcccacttttccaaactgtgcttcaactgatgtgagcgcagcttgcaatgcagcttcagaacggtctgcaacagtgaccaacttgtgcgtggtgcttctgggtgaacaggcagagctggactgaacttgcaagagcacagcacgatcaccaagtgaggacacaagagaactggtgagtgcagagccatcgtcaaccacaaccacaggacgtgctccaccttcagccagcacaagttcagcaggaagaggcagggttgtgatgactgggaaagtcaagctcaaatcttcacactcagaaccaaacaaagttggaaggagggcaggtgctgacggagctgcaggagctgaacctccagaggcagcaactatctcagccttcatggcatcgaccacttctccaaccgttctggtccttgacaacgcatcgacatctttggcctcaacacccagctgaccttgaacctcagaaaggatttccacacgcttgatgctatcaatcccaagctcggcttccaagtccatgtcagcctcaaccatgtcagcctcgtagccagtcttggcagccaaaacagccatgacaacagtttcagcttttgaaaggagggcttgcaaatcagcactaggagcggtggctggcgtgggagctgcagaggctgctggtgcggacggaacggcagctgcaggtgctgaccctcctgacgctgccactatctcagccttcatggcatcaaccacctctcccaccgtccttgttctggaaagagcatcaacatctttggcctccaccccaagctgaccttgaacctcagagaggatttcaacacgtttgatggagtcaattccaagttcagcttccagatccatgtccgcttccaccatgtctgcctcatagccagttttcgcagcaaggactgccatcacaactgtctcagccttgctcaggagagcttgaaggtccgcacttggtgcagtagaggcagctggtgtgggagcggcggaggcagctggtgcgcttgggacagcgggtgcgggagcagaaccagcactggcagcaacaatctctgccttcatcgcatcaacgacctcaccaactgttctggtccttgagagggcatccacatccttcgcctccactccgagctgtccttggacttcactgagaatctcaacacgcttgatgctgtcaatgcccaattcagcctcaaggtccatgtcggcttccaccatatcagcctcatagccagttttcgcagccaggacagccatgacaactgtttcagccttcgcaagcaatgcctgcagatccgcactcggtgctgtggcagctgcaggagtcggagctgcgctggctgctggagctgacgggaccgcaggtgcaggtgcagatccaccgctggcagcgacaatctcagccttcatcgcatcgacaacttccccaacagttctggtcctactgagggcatcaacgtctttcgcttcaactccgagctgaccttgcacctcagagagtatctccactcttttgatggaatctattccaagttcggcttccaaatccatgtcagcttcaaccatgtcggcttcgtaaccagtctttgcagcaaggacagccatcacaactgtttcggctttggacagcaaggcttggaggtctgcagaaggagccgtggatgcagctggagttggagccgctgacgctgcaggtgcagaaggaactgctggagcaggagcggagccagcagaggcagccacaatctcagccttcatggcgtccacgacctcaccgacggttctggttcttgaaagcgcatcgacatctttggcttccacacccaactgtccttggacctcagacaagatttcaacacgtttgatgctatctattcccaactccgcttcaaggtccatgtcagcttccaccatgtcagcctcgtaaccagttttcgctgcgagcacagccatcacaaccgtctcggctttagacaggagagcctgaagatcagcactcggagcggtactcgcagcaggtgtcggagccgctgatgcagctggtgcagaggggacagcaggtgctgacccaccagatgcagcaacaatctcagccttcatggcatccacaacctctccgacggtccttgtacgtgaaagggcatcaacatccttcgcttcaactccgagctgcccttggacttcactcaggatctccacccttttgatggaatcaatcccaagctcagcctccaaatccatatctgcttccaccatgtctgcctcgtagccagtctttgcagccaaaactgccatcacgaccgtctcagctttcgccaggagtgcttggaggtcggctgatcctctggtggacttgctgtttccgctaactggtgaggatgttggtgtaggggaagaagtgggtgttggaacgactgttgccacgggaactgcttgctcatcacaatcttggagcatcctctggagcagttccttgtgtctcctaagcacttccgcagctgcattggagtcagagttctcacctttctcttgctgttgctgttgaaccttcctctccaagtcttggattgtcctctccaattcagcgaccttggattgagctgcttgggctgcagtgcttgcttcagcaagctgacgctggaggtcttgtgcttgtctgacaagtctctcttcgtttgcagtgtccacttctttgacaaccgctgtggcaccactcacagtgtaaccatcattgagcacagcctccctctgcctcaaggtcttggcagagacataggtggcagcactcaacctcaaggttgttttctttttcttgacaggctcaagacgagtggcatcgggaagctgccatctgtcaaagtctttgagtggaacaccagccacagccaaggtgagagctgcttgtctcagctgggtgtctgaatccttggctgagtctgggttgacagccaccgtgaccacgtctccagcttccccaagggtctctttgaccaaacgagaaaggacttgcttgggaccgaactcaacaaacacccttgctccagctgcgtgcatggcacggacttgctgcacaaactgcacaggagaagtcatgtgtttcccaaggttcgttttgacatcagcaggagaggtgactgcagctccaccagtgacgttgctgtagaatctggcagctgcaggtgcggacactggagcttgagcaagcgcagacgcaaatgtctgctctgctccacgcatgtgtggtgaatggaaggcagcttcacaagcaagaggaaccactctgaagtttccactacaacgaagtttgtcagatgcagctgccactgcttcagcagttcccgtgatcaccgtctgtgatggactgttgctattggccagccaaacatcaggtgctccaccaaggctgagctgatcagccttggctcctatgaccgctgccatagcacctccactggagctggcttgagcagtgaaatcagacatggcctttgccctagcgcaaaccaagtcaaacacagcatcacgatccaatgaaccagctgcatagagagctgcaaactctcccagggaatgtccagctgcaaaagaaggagccaatccagctgctttgaagatgtcaaaggcaccgacagagcaagcgagggttgctggctgagagtaacgcgtctgagaaatctctttgtgatcttgccttggctcatctccataaggttttctcggatagagaacactggagactcttttggctggcctcccaaaacgttctctctgcgctctgtccatcgcagcaacactctctctgaacggaggccagttcatggcaacatctgagaacatgtgagtgtactgcgctccttggccagagaaaagtgcagcaacattggcctctgtggcaacacccctaactctgaatgcagcctcaccagtggcaactgagaccgtccattccgttgctgactcttctccagcaagtttggctgcagctgcttccaaaaccgcaatgagagaggacaggtccctcaccagaagtccaacccttgcgtgggcttggggaacagctcctctcaacttacattcatcaaggaacctatggtatgcaatgtaatcagcgttcttcacaactctagcctcttcttgctcagcagtggccaatgccagttttgccctaactgtggcagcaagagttgcaacatccccagcatgaaggagagcaacttggggaagattgttgtaacggtaagcactctcatgttcaggttcaaactcttcaagcacagcatggtagttcgcacctccaaaaccaaatgaggaaacgccagctctcctcggaaccccaaccggagtgaaccagggacggttcatggtgttgacgtacaaaggggactgttgaatcggtgtcccatccaccagtgaaggtggcttgtccacattgatcgtctgaggcaatgtcttgtgcttgagagcaaggaccactttgaccaatccagccaatccagcaaccgctttgaggtgccctatctggctcttgatgctgccaacagcaacttgctcagcttcctcagctccacctccattcgcagaaaacgctttggagaagagattgctcagagctgtgagttcaatcttgtccccaaccggagtgccagttccatgtccttcaacaagagtgacagtggctgggtccacattggcacgtgcataggctctacggagagcctcttcttgtccgctgattgtcggtgtgtagattccagctgcttttccatcacttgaggaagcacagcccttgatgacagcatgaacagtgtcaccatctctgacagcatccgcatatctcttcagaacaagcatcgcagatccttcaccaatcaacatgcctttggtggcagcatcatacgctttgacactcgggtccgtagagaaaacaggcgtcttggagaaggccatgtacatccctattgaattgtctgtgcaggtggcaccagcaatcatggcatcacagtcaccatagagaagctcttctattgccaccttgaccgcaatcaggcttgaagcacaggcagcgtcaacgacacagttcatgccctccatgttgaaggtgttgcaacatctgccagcggtaacattgcccaagaaaccaggaaaagaatcaagcctccactctgggaagctcgccttgtacttgtccaccgcagctgccacatcttcctctggcaaacccatctttctgagcactttgtcaaccacaacatagttgagtctggagtagaactcatgtgacgccttctgacctccacctatgccaagaacacaaccaatgttctttttgccacttgagaaagcaggtatgttggcatcggtgagagcttccttcaccttgagcaatgagatggtctggttcgcatcagaatcttccatctggaacatgttgaggccaaactcacgagcatcaaagtcatactcagggatgaacccacctcttttgcagtagattttgtccttggtcgttttctctggattgtaataggcagtcacatccacacgatccgcaggcagatcagacagacaatccaagccatctctgatggcctcccagctctctctaacattctcaccactcggaaggatcgcactcattcccacaatggcaattctggtatccatttttggttgtggatccctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctactaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggagcggccgccctaggtctagatcgacacaactttgtatacaaaagttgtctagacctagggcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccttttagtattaagagaagaaccaaaggctttgttgttttcataatctttctgtcattttcttttattatgatgtcaagtcaagcgactctttggtagtaatctgtatgccatggatctctctctctatttgtcgactgaaaacttttgggttacacatgaaagctttttctttttctaaaatccaaaatgaaagagttgtattaacagatacataagtgaaagagtagtccctaagatgacactagcttcatttataaacaatcctatcacattgtatatacaggttatgatttattcccaatcagcgtcaaagaatccagcatctttcatctctgaatagtagacattctccaagtttagatcttcctcctcgatcaaagcggccgcttaattaaactagaaccggtgactactctacagccttggattaggcacggcatcgcgatctcttgggccgttgacttttaacttgcgatgacttttctaatttacgagtcaataaccattctccctcagatattgacttgttcgtagataagtgtcactttggaagctagcattacgagtacacgggtcggcaacttgcaaatcgtcgaaaattgctatgcaagttgatctctgatttggtagtacactcagctttgtgatcagccaatactcattacgtggtttattagcaaaatgaatcgacatgagccacagcgagtgacaccagttacgattccctcacaacctccgtctcgtgaaacgtaatagatcagcgttgtatgatgtaagatattgtagttttggatgtcaacgtagggtcgtgaagaggtttattaactcacatgttggaacccttagtgagttttcactttacaaatcacgcgtgccactacgtattacttcatcgtagatagggacaacacagaaacgaaagtgcgaaacctttacatcaccaggtcccaggcgagattcccaggggtgactaaaagtacgcatttgaaaactatgggggctattgaatctaaacatcagatagtcaccatgatcaatatccccgttacgcttgcttcgtaatctgggggagtagccgcttcccgcgcttacgagcgtgctcaagggccatacaaactgaccccagtgagccgttcagagtgcgtgccattgagaattggcgtacttctgttgaaaaaagtgcgataacgctcttcagggtggtcgataacccaagcgtagaatcacactttgcagaggatatgaggttcttaactaggatacttggggcgatcatcaagtaaggatgaagtcgcgtacgtactttctacatgctcagctaaagtgcaagcgggggacatgacgagatgattccaggaatcggggacattggcttagggcttatagatgtcttgttcgataacaccggtggatccccgggtaccgagctcgaattcctcgaggtcgaccaacttttctatacaaagttgtctaggtcgacctcgaggctagcactagtttaattaagcggccgcgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactgagctcggtgacctaagtgattaagctaactactcagagtgcatgatctggtctgtaggtgaagaggtcatcttcagtgtccacatctatccttggtgcaagtttgacactgagcaatctctggagatacgcagcaccagacaggatttgaaggttgatctgcacaacatcagggaactcaccagagactgcaacatcaagatagctgtctgcaatgaaatcgttgaaggctcctatggcaggtccacaccaaatctggtaatccatcgtacggtcagctatgccattgtttgcccagaatgagctgagacccaagtaccaacggaagcagagggacatcttgagcttggggtcctcattctcagcctttctgatcttttcaggattgttgagacgagtgatgtagaaatctttggtctctgcccaaacttctgcaagggacttggagaagatcctcttctcaacacgagccaattcatccgcaggcattgcttcaaaggaatcatacttgtggaacagttcaaagagtttcttggcacgagatgggaacatcgttcctttcttgagaacttgcagttcaactccttgttcaaacatgtctgcagctggtgccatcgtgatgtcagagtaagtggcacgagagagctgacgcctcacgttgtcacatgttccagcttgacgggacagctggttgacagtgccagtcacaacaaacgcagctcccatgtggaaggctccaagtgcagcttgaggacaacctatgcctccaccagcaccaaccctaacacggtgtctggcagggtacttgagttccctctggagcctattcctcagactgaggatcaacggcagaatgacatgaatgggacggttgtcagtgtgccctccactgtcagcctcaactgcaatgtcatcagccattggaacttcaagagccaacgcagcttgctcaggggtgatttcaccagacgcaacaagtttgtccagaattgcttgaggtgcaggtctgatgaacatctccgcaagctctgttctggaaacctttcctatgatcttgtgtgctgtcctcactgagccacctctcgcatctctggagagtcccgtggctctgtaacggaccacttgtggtgtgagttccatgaaggcagacgcctcaaccacacgaactcccttttccaggaaaagatcaacattgcccttttccaggttggcatcgaacggtgagtggatgaggttgacagcatacggaccagcgggaagtgcagcttggatcttttcaatcccagcacggacaacgtgcattggcaacccaccagctccaaagctccccaacatcttcctctgacccattgctatgaccagatccgcagaggctattcccttggccatcgcaccactgtacaacggagcaaccaccccataagtctccatgaatccacggtctcccaaatcgctgacagcacaggctggcacctcacttccagcatccaactgcaatggtctctccagtgtcagcaacgcttgtttgagagcttgaagatcagccacatccacatcagcaatgctggagttctttgtggtggctttggcagcaacttcttgctcttcaacatggccagctccagtctggattctgaccctcaggttgtctgctgaatagactctgaggccatcaacgaagaggaacccatcagcaaccacatcaacccatgaggagaaggcagcaacactcttgatgtgaacttcactgtccattctgtcattctttggggtcaactgacctctgtacttccagctggtggcaccaggtgcatgtgcaaagactggatgagcaattccatgccttgcagccaagccttgtttgacacaccacgcttccacaagctggaacatggactcaattcccaaagacccaggcatcactgggtcaaaccagaaatggcaagaaaagaaccaatcttgcttgttcacagctttctccccatgagcataaccttggccatgcactccagctccactcccagcaagatgaattgtgtccaggaactgcgcttgtgaccctctcctctgaagctgaagctgaccttgggcactagaagctgacgcaggtgctgagagtgtgtccactgccacattgttttccctataccaaggcaacctcggcttgccattgtccaatccagtctggctctcaaagacctcaggaacaaaccaaccaaaagaggtgctccctttgtagaaaactgctccgtcaacagagagttcgaaggtgaaacgatggattcccatcttgccaagcatggagtatcccgtgcatttggtgaagttccttatggttttccctctgacatcaggcatggcatcacccacaagttctgcatctgcatcaaggtttctgaaaaggatgtcatctttgtccattgtgagcggagctttgagcacagatgtgaggactccagaagtctgaagagcaatctccatcaagatgctgtacggcatgtgatcgtctctgcttgaggctccaaagaaccaagcatctgcaggacaatcaaactcacccaccatcgtgccttggccagggttgacatccacattgtagaaaggaccatgttccatgtcagccacactcgtcacccttgtcacaagagccaggtcaaaagctggtgatctggatgtcttggaagcatcaaatctggcaaactcaggacccaagcagttgctcacttttccacacatgaactcagacatgttgaaccaggtcaacggcatttggccaggtgtatgatcattgtcaagcggattgttggggaaaggagagaagcaaacagctctgggaggatacgctgaaggagagaaggacggagtgggtccaggacctccatttccctcagccattggatgccacgtgacagaggtgggagcagtgggatcacctttgaggcatccacttggaggagcaatcactctgctggttgtcgtggtcgtagtggtgacagtcatgctctctttctgttgctccttccttttctgcagtgacaacgcaattcccttgaaatccacaactatctttttcctcaaatctccttggccatagctgtgaagatcctcaactccagcaaacgcttgtccctcttcaaagttgacatcaatgatgtcaacatcagctatggcaaatggatctccagttttggcatcaaagcccatttctttgatctccatgacataaacaagtttccccttgtgcggtgaaatctgtccacgacacctcactttgttggcatgaccactgactggacgaaagtcgaacgcaccaacagtggtgtgaaggccaagccacaacatgtaaaccttgagaagctgagagcatccatctgagacaagagaaccagccatgacctcatccctcacaaagtggcaggggaagtaccagtggtccctctcaagcactttctccccaatgagaagcccaagaccgtgagcacctccacgcggatcaaggtgtgtgactctgtcaatcatcagcatctttctcgcacacaacttgtagtctatgccagccattccagaaccaaagacccttgcccattgcctatcaacaagcagtctcatttctctggcatccaagctggttttgtgactgcacggtgcaggtgcaaagggtgcaatgtcttgtttctggatctgagcacgtgcagcaagctcagccttcgttttgagcacaccttttccagcggcaagttcggcatcagtaaagaagccagcacaaccatctctcatctctatgagcaatctgccatcaacaaagcagtcatactcgaaaaagaacattgagatttccccaccagcacccttggcgaaaccagtgactctgatgtcatacacaagggtttctccttcatgggcaaccccaaagaaggtgagagatgtgttgagcaatctgtaaacacggtcccctttgcactggaagtcaatccccatgtaggagatgagcatcaagtcacactgcccactttcaacaagaactgcccagggaacatcacctccctctgacaactcaccattgactggaacatcatactcagtgaccattctggagccaactctgaagttattcacctcggcatccatgagagtcactcttgaaacaagcaagtattctctggctggaagcctcacacgccttctgtacttgtcaatgatgtcaaactctggtccaaacacttgaccaacatcaccctccgcaaactccaacagctcgttgtagtcaaagacaaccgtcttgccatccaacagctcttccttgctcatttcccaaacaggagttttctttgaagatgtcatttttggttgtggatccaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctgcggccgccctaggtctagatcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgccgtgtgacaacattgctgtggttggaatggcagttcagtatgctggatgcaagaaccaggacgagttctgggacacactgatgaggaaggagatcaacagctcaccgatctcagcggagaggcttgggacaagatacagagacctccacttccatcctcagaggagcaagtatgcagacaccttctgcaatgacagatatggttgtgttgatgcttctgttgacaatgagcatgacttgcttgctgaccttgccagacgtgctttgcttgatgctgggatcaacttggatgacgccagcaccactgccaaccttcgtgactttgggattgtgagtggatgcctctccttcccgatggacaatctgcaaggtgagcttttgaatctctatcaagtccacgttgagaaccgtgtgggtgcccagaggttcagagattcaagaccctggtcagaaagaccaagagctgtgtcccctgaagccagtgacccgagggtctacagcgaccctgcttcctttgtggccaaccagcttggtcttggtcctgtcagatacagccttgatgcagcttgtgcgagtgcgctgtactgcctcaagttggcttctgatcacttgctctcccgttctgcagatgtcatgctgtgtggtgccacatgcttcccagacccgtttttcattctctctgggttctccacattccaagcgatgccattgggtggaccagatgacaacccactctctgtgccactccgtcaaggcagccaaggactcacacctggagaaggtggagccatcatggttctgaagcgtttggaagatgctgtgagggatggtgataggatctatggcaccttgcttgggacaagtctcagcaatgctggttgtggtttgccactttcacctcacctgccgtctgagaaaagctgcatggaggatttgtacacgtcagttggcatagatccatctgaggttcagtatgtcgagtgtcatgccaccggaactccgcaaggagatgtggttgaagttgaggctctgagacattgcttcagaggcaacactgaccacccaccgaggatgggttccaccaaaggaaactttggtcacaccttggttgcagctgggtttgctggaatggccaaagtgttgctttccatgcagcatggcacgatcccacccacgcctggtgttgataggagcaactgcatagatccgctggtcgttgatgaggccataccctggccttacagctcagctcaagcgagagctggcaaacctggagatgaattgaagtgtgcttccctctcagcctttggatttggtggaacaaatgctcattgtgtgttcagagaacacagacagattgctgccactgcgacagcgtctccggtccttcctgaagtcacccctggacccattgcaatcattgggatggatgcgacgtttggcaccctcaaaggacttgatgcgtttgaacaagcgatctacaaaggcacggatggagcatctgatctgccatccaagagatggaggttccttggtgctgacacagatttcttgactgcaatgggtctggatgcagtcccgagagggtgctatgtgagggatgttgatgtggactacaaaagactcagaagtcccatgatccctgaagatgtcctcagaccccaacagcttctggcagttgccacgatggatagggcacttcaagatgctggcatggccacgggtggaaaagttgctgtcctggtggggttgggcactgacactgagctttacagacaccgtgcaagggtgacactcaaggaaaggcttgacccagcagctttctcccctgaacaagttcaagaaatgatggattacatcaatgattgtggaacctcaaccagctacacttcttacattgggaatcttgtggccaccagagtttcctcacagtggggattcactggtccttctttcacggtcactgaaggtgcaaactcagtctatcgttgccttgagctgggaaagttccttttggacacccaccaagtggatgcagttgtggttgctggagttgatctctgtgcaactgctgagaacctttacctcaaggcaagaaggtctgccataagcagacaagaccatccacgtgccaactttgaggcttctgctgatggatactttgctggagagggcagtggtgctctggtcttgaagaggcaagctgatgttggctcagatgacaaggtctatgccagtgttgctggcctcacatgtgcagcgcagcctgctgaagcagtttctcctcttctccttcaagttcacaatgatgacaatgagaaaagggttgtggagatggtggaactcgcagctgactctggtcgtcatgctccccacttggccaactctcctttgagtgctgaatcacagcttgagcaagtgtctaaactcttggctcatcaagtccctggttcagtcgcgattggaagtgttcgtgccaatgttggagatgttggatatgcgagtggtgcagcttctctcataaagactgcgctttgcctccacaaccgttacttgcctgcaaacccacagtgggaaagacctgtggctccagtctcagaggctcttttcacctgtccaaggtcccgtgcttggctcaagaaccctggtgagtccagacttgctgcagtggccagtgcttctgagagtgggtcttgctttggagtgcttctcacagatgagtatgccacacatgagtccagcaacagattgtcattggatgacgctgcacccaaactcatagcgattcgtggagacactgttgatgacatcatggcaaaagtcaatgctgaacttgcgttgctccgtgctcatgcagaaactgggtctgccactgacgatgacccagctgcagctgttgctttcactgctcatcgtttgaggttcttgaggcttgttggtgaaacagttgccagtcacggtgccacagcgaccttgtgtttggctctgctcacaactccagaaaagctggagaaagaattggagttggcagccaagggtgttccaagatcagccaaggctggcagaaactggatgtcaccatctggttctgcttttgcaccaacacctgtcaccagtgatcgtgttgcgttcatgtatggtgaagggaggtctccctactatggtgttgggttggaccttcacagactctggcctgctttgcatgagaggatcaatgacaagacagctgcactttgggagaatggagactcctggctcatgcccagagcggttgatgctgactctcagagggctgtccagacggcttttgatgctgaccagatagagatgtttaggacgggaatctttgtttccatttgcctcacagactatgctcgtgatgtccttggagtccaacccaaggcttgctttggactctcccttggagaaatctccatgctctttgcactttcaaggagaaactgtggactttctgaccagctcactcagaggctcagaacctctccggtctggagcacacagcttgctgtggagttccaagccttgaggaaactttggaatgtccctgctgatgctccagttgagtccttctggcaaggctacttggttcgtgccagcagagcagagattgaaaaggccattggaccggacaacagatttgttcgtttgctcattgtcaacgactccagcagtgccctcattgctggcaaacctgctgagtgtctgagggtgcttgagcgtcttggaggtcgtttgccacccatgccagtcaagcaaggcatgattgggcactgcccagaagtggctccctatactcctggaatagctcacatccacgaaatcttggagattcctgacagccctgtcaagatgtatacctcagtcaccaatgctgagctgagaggaggcagcaactcttccatcacagagttcgttcagaagttgtacaccagaatagcggatttccctggcattgttgacaaggtcagccgtgatggccatgatgttttcgtggaagttggtccgaataacatgaggtcagcagctgtcagtgacattcttgggaaggctgcaactcctcatgtcagtgtggctcttgatcgtccaagtgagtcagcttggacacagacactcaaatctcttgccctgctcactgcccacagagtgcctcttcacaacccgactctctttgcggatctttaccacccaaccttcctcacagccatagattctgcaatgcaagaaccacctcccaagcccaacagattcctgaggtctgttgaagtcaatggttacttctgccctgatggcataagcaaacaagttgcagctgcaagtgccaaacccagcacacattgcatggttcgtctccatccagccaaagctgttgtggttgcagctgccggagctgtggttgctgattcaacaccggttgtcaaagccaagcagacttcctcatctttgcttgttggagacgatgccttcctcagatgctatgatgtggattggcctctctacatgggagcgatggctgaaggaatctcctctgttgaccttgtggttgcagctgcagaagctaggatgcttgcatcatttggagcagcgaggcttccgatggatcaagttgaactccagatccgtgagatccaacagagaacctccaatgcctttgctgtcaacctcatgcctggtcctgatgaagctgcaacggtggatgcccttctgagaacgggagtcagcattgtggaggcgtctggttacacgggtgcgctctctgcggatctggtgagataccgtgtgaccggtctcagaaggacctcctgtggtgcttctgtgtcagcgactcaccgtgttgtggccaaagtttcaagaactgaggtggctgaacatttcctgagaccagcacctgcagctgttcttgaggctttggtggcagccaaacaaatcactcctgagcaagctgcgcttgccagcagagtcgcgatggctgacgatgtcgcggtggaggcagattctggagggcacactgacaaccgtccaatccatgtgctccttcctttggttgtggctcagaggaacagatggaggcatctggttgacacgccagtgcgtgtgggagctggaggtgggatagcatgtccgagagcagcgttgcttgccttctccttgggtgcagcctttgtggtcactggaagtgtcaaccagcttgctcgtgaagctgggacctctgatgcagtcagactccttttggcgactgccacctatagtgatgtggcgatggctcctggtggagtccaagtgttgaagaaacaaaccatgttcgctgcgagagcaacgatgttggctcagctccaagccaagtttggttcctttgatgctgtgccagaaccgcaactgagaaaactggagagatcagtgttcaagcagagtgttgctgatgtttgggcagctgcaagggaaaagtttggggttgatgccacggctgcaagtccgcaagagaggatggctctctgtgtcagatggtacatgtctcaaagctcacgttgggcaacagaggccacttcagcaaggaaagcggactatcagatttggtgtggtcctgcaataggcagcttcaatgacttcgtcagaggcaccaaacttgatgccacggctgggactggtgagttcccgagagttgtggacatcaaccagcacatcttgctgggagcctctcattacagaagggttcaacagcaacagcaagacgatgacgttgagtacatcattgtttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagcttt

SEQ ID NO: 39 - protein, 237 aa, Nostoc sp.
MLQHTWLPKPPNLTLLSDEVHLWRIPLDQPESQLQDLAATLSSDELARANRFYFPEHRRRFTAGRGILRSILGGYLGVEPGQVKFDYESRGKPILGDRFAESGLLFNLSHSQNLALCAVNYTRQIGIDLEYLRPTSDLESLAKRFFLPREYELLRSLPDEQKQKIFFRYWTCKEAYLKATGDGIAKLEEIEIALTPTEPAKLQTAPAWSLLELVPDDNCVAAVAVAGFGWQPKFWHY

SEQ ID NO: 40 - protein, 781 aa, Schizochytrium sp.
MAPTPDATAPLNKPSDYAVYHEEDGPFWTADSSGVSRVNFSETGVGSEGVIPALTLIDVFERAVKRGGNRIAFRTENMPTLRRGEEAPDALPLKDWKSWSWKQYKADVHRIARALMDLGVEQHDAVSIFGFNSPEWFLSAVGAVHAGAKIAGIYPSDTPAQVQYKAFHSDTAVAVVENEQCFKKFAEVVEDLPYLKAIVCWDYEATDITREDGSVVEVLTFAEFLKRGDTVEAAALDERISKIEPTMCAALIYTSGTTGRPKAVMISHDNLVFEASAVVPNLGGACTTTAEERILSYLPLSHVAGMMVDIIAPIIATAFHKGRICVCFARPYDLRTGTLGQRLNAVEPTIFLGVPRVWEKIQEKLMAVGAKTTGLKKKLSTAAKKRGLEFQEEQQIGRSGANPGFGPLGIYKKLLGLIKGKLGLTKCKFAFAGAAPMTRETLQYFGALNININEVYGMSECSGAATWSTDKAHEWGTVGYEMPSCEVRVFKIAEDGTKTECPRAADIMHATEEEQGEVCFRGRNIMMGYLANPKLGDDHVAEIEEKNAAAIDSEGWLHSGDKGAISTRGMLKITGRYKELIIGAGGENVAPVPIEDAIKARMPFVSNAMMVGDKRKFMAVLLTLKTVGATGELPGTNKLMGAAADYGETIEDACDNEALIEEITQQLKEIGDDGDVTPSNAARIQKFTILPLDFSVSTDELTATLKLKRSVVADKYEDIIEAFYESKSVFVPYSTVGAYATGGPVDDSVVDGSFKGDFSMIGDDDPDLQNVDVLEAIDEDN

What may be claimed is:

1. A plant expression construct comprising:
(A) a first expression cassette comprising
a first promoter that is functional in a plant cell, and
a first polynucleotide encoding a first polyunsaturated fatty acid (PUFA) synthase system polypeptide comprising an amino acid sequence that is at least 95% identical to SEQ ID NO:1,
wherein the first polynucleotide is operably linked to the first promoter;
(B) a second expression cassette comprising
a second promoter that is functional in a plant cell, and
a second polynucleotide encoding a second PUFA synthase system polypeptide comprising an amino acid sequence that is at least 95% identical to SEQ ID NO:4,
wherein the second polynucleotide is operably linked to the second promoter;
(C) a third expression cassette comprising
a third promoter that is functional in a plant cell, and
a third polynucleotide encoding a third PUFA synthase system polypeptide comprising an amino acid sequence that is at least 95% identical to SEQ ID NO:14,
wherein the third polynucleotide is operably linked to the third promoter; and
(D) a fourth expression cassette comprising
a fourth promoter that is functional in a plant cell, and
a fourth polynucleotide encoding a phosphopantetheinyl transferase (PPTase) polypeptide comprising an amino acid sequence that is at least 95% identical to SEQ ID NO:39,
wherein the fourth polynucleotide is operably linked to the fourth promoter,
wherein the expression cassettes are arranged in a tail-to-tail or head-to-head orientation in the construct.

2. The plant expression construct of claim 1, wherein the construct further comprises
(E) a fifth expression cassette comprising
a fifth promoter that is functional in a plant cell, and
a fifth polynucleotide encoding an acyl-CoA synthetase polypeptide comprising an amino acid sequence that is at least 95% identical to SEQ ID NO:40,
wherein the fifth polynucleotide is operably linked to the fifth promoter.

3. The plant expression construct of claim 1, wherein the expression cassettes are arranged in a tail to tail orientation in the construct.

4. The plant expression construct of claim 1, wherein the expression cassettes each further comprise a 5' UTR, a 3' UTR, and a termination sequence.

5. The plant expression construct of claim 1, wherein each of the promoters is a seed-specific promoter.

6. The plant expression construct of claim 5, wherein the promoters are not the same.

7. The plant expression construct of claim 1, wherein the expression cassettes are arranged in the 5' to 3' order A-D-C-B.

8. A seed comprising the plant expression construct of claim 1, the seed comprising at least one polyunsaturated fatty acid (PUFA) selected from the group consisting of eicosapentaenoic acid (C20:5) (EPA), gamma-linolenic acid (C18:3) (GLA), and arachidonic acid (20:4) (ARA).

9. The seed of claim 8, wherein the seed is a soybean seed or a canola seed.

10. A plant producing the seed of claim 8, the plant comprising the plant expression construct.

11. A cell, tissue, or part of the plant of claim 10, the cell, tissue, or part comprising the plant expression construct.

12. A genetically-modified plant commodity product comprising the plant expression construct of claim 1.

13. The genetically-modified plant commodity product of claim 12, wherein the product is a feed or meal composition or a functional food product.

14. The genetically-modified plant commodity product of claim 12, wherein the product is an oil.

15. The oil of claim 14, wherein the oil comprises at least one polyunsaturated fatty acid (PUFA) selected from the group consisting of eicosapentaenoic acid (C20:5) (EPA), gamma-linolenic acid (C18:3) (GLA), and arachidonic acid (20:4) (ARA).

16. The oil of claim 15, wherein the oil is a raw or unmodified oil.

17. The oil of claim 15, wherein the oil is a soybean oil or a canola oil.

18. A method for obtaining an oil comprising at least one PUFA, the method comprising recovering an oil from the seed of claim 8.

19. A method for producing an oil comprising at least one PUFA, the method comprising cultivating the plant of claim 10 to produce a seed comprising the oil.

* * * * *